(12) United States Patent
Feitelson et al.

(10) Patent No.: US 10,973,187 B2
(45) Date of Patent: Apr. 13, 2021

(54) PLANTS WITH MODIFIED DEOXYHYPUSINE SYNTHASE GENES

(71) Applicant: Agribody Technologies, Inc., San Diego, CA (US)

(72) Inventors: Jerald S. Feitelson, San Diego, CA (US); John E. Thompson, Waterloo (CA); Catherine A. Taylor, Boundary Creek (CA)

(73) Assignee: AGRIBODY TECHNOLOGIES, INC., San Diego, CA (US)

( * ) Notice: Subject to any disclaimer, the term of this patent is extended or adjusted under 35 U.S.C. 154(b) by 0 days.

(21) Appl. No.: 16/235,837

(22) Filed: Dec. 28, 2018

(65) Prior Publication Data

US 2019/0203220 A1 Jul. 4, 2019

Related U.S. Application Data

(60) Provisional application No. 62/611,505, filed on Dec. 28, 2017.

(51) Int. Cl.
| | |
|---|---|
| A01H 1/06 | (2006.01) |
| C12N 15/82 | (2006.01) |
| C12N 9/10 | (2006.01) |
| A01H 1/04 | (2006.01) |

(52) U.S. Cl.
CPC .......... *A01H 1/06* (2013.01); *A01H 1/04* (2013.01); *C12N 9/1085* (2013.01); *C12N 15/8213* (2013.01); *C12N 15/8216* (2013.01); *C12N 15/8249* (2013.01); *C12N 15/8261* (2013.01); *C12N 15/8266* (2013.01); *C12N 15/8273* (2013.01); *C12N 15/8279* (2013.01); *C12Y 205/01046* (2013.01)

(58) Field of Classification Search
None
See application file for complete search history.

(56) References Cited

U.S. PATENT DOCUMENTS

| | | | | |
|---|---|---|---|---|
| 2005/0155109 | A1* | 7/2005 | Hurst | .............. A01H 1/00 800/284 |
| 2010/0333233 | A1 | 12/2010 | Thompson et al. | |
| 2012/0034673 | A1* | 2/2012 | Thompson | .......... C07K 14/415 435/193 |
| 2013/0227740 | A1 | 8/2013 | Gan et al. | |

FOREIGN PATENT DOCUMENTS

| | | |
|---|---|---|
| AU | 2005311640 B2 | 8/2011 |
| WO | 2004/020642 A2 | 3/2004 |

OTHER PUBLICATIONS

Phillips et al. Delayed leaf senescence in soybean. (1984) Crop Science; vol. 24; pp. 518-522 (Year: 1984).*
Li et al. DHS1 (Glycine max). (2009) GenPept; GenBank ACM89613; p. 1 of 1 (Year: 2009).*
Li et al. Glycine Max DHS1 mRNA, complete cds. (2009) GenBank FJ014861.1; pp. 1-2 (Year: 2009).*
Wang et al, (2005) Antisense Suppression of Deoxyhypusine Synthase in Tomato Delays Fruit Softening and Alters Growth and Development, Plant Physiol.,138:1372-1382.
International Search Report issued in PCT/US2018/067954 dated Mar. 27, 2019.

* cited by examiner

*Primary Examiner* — Cathy Kingdon Worley
(74) *Attorney, Agent, or Firm* — Morgan, Lewis & Bockius LLP

(57) ABSTRACT

The invention relates to methods of producing a plant with delayed senescence comprising inducing at least one nucleotide deletion, insertion or substitution into at least one copy of a gene encoding deoxyhypusine synthase (DHS) in the plant, wherein the nucleotide deletion, insertion or substitution decreases the activity of DHS encoded by the gene in the plant. The invention also relates to plants produced by the methods and progeny thereof.

19 Claims, 18 Drawing Sheets
(7 of 18 Drawing Sheet(s) Filed in Color)
Specification includes a Sequence Listing.

```
              1                                                    50
H.sapie.      ..........  ..........  ........ME  GSLEREAPAG  ALAAVLKHSS
A.thali.      ..........  ..........  ..........  .MEDDRVFSS  VHSTVFKESE
C.sativ.      ..........  ..........  ..........  ..MEDRVFSS  VHSTVFKESE
B.rapa        ..........  ..........  ..........  .MEEDRVLSS  VHSTVFKESE
B.napus       ..........  ..........  ..........  .MEEDRVLSS  VHSTVFKESE
G.hirsu.      ..........  ..........  ..........  ..MDDKLVNS  VRSTVFKDSD
P.delto.      ..........  ..........  ......MTGK  KQWEEDLLSS  VRTTVFKESE
C.sinen.      ..........  ..........  .......MGE  EDMEERLLDS  VRSVVFKESE
V.vinif.      ..........  ..........  ..........  ..MEENFLSS  VRSVVFKESN
M.sativ.      ..........  ..........  ......MSET  KQEDDTIMSS  VHSTVFKESE
C.ariet.      ..........  ..........  ......MSES  KQ.DDIVMAS  VHSTVFKESE
A.duran.      ..........  ..........  ......MGEA  KE.DNVVLSS  VHSTVFKESE
A.ipaen.      ..........  ..........  ......MGEA  KE.DNVVLSS  VHSTVFKESE
G.max_1       MAQTLKLKTR  LSLFCGEKKR  ET.DRTMGEA  KGKEEEVLAS  VHSTVFKESE
G.max_2       MAQTLKLKTR  LSLFCGEKKR  ET.DRTMGEA  KGKEEEVLAS  VHSTVFKESE
P.vulga.      .....NYTVS  VALRAEEREE  ERRERIMEET  KRKEEEVLAS  AHSTVFKESE
B.vulga.      ..........  ..........  ..........  ..MEDNTMAS  VHSTVFKESE
S.lycop.      ..........  ..........  .......MGE  ALKY.SIMDS  VRSVVFKESE
S.tuber.      ..........  ..........  .......MGE  ALKD.NIMDS  VRSVVFKESE
C.canep.      ..........  ..........  .......MGD  ALNGGNPLES  ARLAAFKQSE
T.aesti.      ..........  ........M  AGEGGSGGE.  ...RSKDPLEG  VRAIVLKPSE
O.sativ.      ..........  ........M  AGAGG.GGV.  ...RDMDALEG  VRSIVLKPSE
Z.mays_1      ..........  ..........  .MAAGAGGG.  ...ELEALEG  VRSIVLKPSE
S.bicol.      ..........  ........M  AGAGGSGGGG  VVRDVEALDG  VRSIVLKPSE
Z.mays_2      ..........  ........M  GAELGEAGVP  ARDMVDALEG  VRSILLKPSE
M.acumi.      ..........  ..........  .MEGGAAGG.  .QRDRETLDA  VRSVVFKPSV
T.cacao       ..........  ..........  ..........  ..MEDKLMNS  VHSTVFKESD
M.longf.      ..........  ..........  ........MG  DATRYTLPEA  VRSTVFKASE
L.sativ.      ..........  ..........  ..........  MGE VVKEAGVIEN  LRSVVFKESE
Consensus     ..........  ..........  ..........  ........l.s  vrstVfKeSe
```

FIG. 1

```
              51                                                         100
H.sapie.    TL.PPESTQV  RGYDFN.RGV  NYRALLEAFG  TTGFQATNFG  RAVQQVNAMI
A.thali.    SL.EGKCDKI  EGYDFN.QGV  DYPKLMRSML  TTGFQASNLG  EAIDVVNQML
C.sativ.    SL.EGKCDKI  EGYDFN.EGV  NYPKLMRSML  TTGFQASNLG  EAIDVVNQML
 B.rapa     SL.EGKCDKI  EGYDFN.QGV  NYPKLLRSML  TTGFQASNLG  EAIDVVNQML
B.napus     SL.EGKCDKI  EGYDFN.QGV  NYPKLLRSML  TTGFQASNLG  EAIDIVNQML
G.hirsu.    SL.EGTCTRI  EGYDFN.QGV  NYSRLLKSML  STGFQASNFG  EAVEIVNEML
P.delto.    AL.DGKCIKI  EGYDFN.QGV  NYSKLLKSMV  STGFQASNLG  DAIQVVNNML
C.sinen.    TL.EGSCIKI  QGYDFN.RGV  NYSELLKSMV  STGFQATNLG  DAIEVVNQML
V.vinif.    SL.EGVRTKI  EGYDFN.AGV  DYSQLLKSMV  STGFQASNLG  DAIQVVNQML
M.sativ.    NL.AGKCVQI  EGYDFN.RGV  DYQQLLKSML  TTGFQASNFG  DAVKVVNQML
C.ariet.    SL.DGTCLQI  KGYDFN.NGV  NYQQLLNSML  TTGFQASNLA  DAINVVNQML
A.duran.    NL.EGKCTKI  EGYDFN.QGV  NYHQLLKSMV  TTGFQASNLG  DAIQVINQML
A.ipaen.    NL.EGKCTKI  EGYDFN.QGV  NYHQLLKSMV  TTGFQASNLG  DAIQVINQML
G.max_1     SL.DGKCVKI  EGYDFN.RGV  NYPLLLSSMV  TTGFQASNLG  DAIQVVNQML
G.max_2     SL.DGKCVKI  EGYDFN.RGV  NYPLLLSSMV  TTGFQASNLG  DAIQVVNQML
P.vulga.    SL.DGKCAKI  EGYDFN.HGV  NYPLLLRSMA  TTGFQASNLG  DAIQVVNQML
B.vulga.    TL.EGKCIKI  QGYDFN.QGV  NYSQLVKSFI  STGFQASNLG  EAIEVVNQML
S.lycop.    NL.EGSCTKI  EGYDFN.KGV  NYAELIKSMV  STGFQASNLG  DAIAIVNQML
S.tuber.    NL.EGSCTKI  EGYDFN.KGV  NYAELIKSMV  STGFQASNLG  DAIEIVNQML
C.canep.    TL.EGTCPVI  QGYDFN.QGV  NYPELLKSMV  STGFQASNLG  DAIDVVNQML
T.aesti.    SLDESRFTKI  AGADFNDAGL  GLDGLLGSLA  STGFQASNLG  DAIDVVNQML
O.sativ.    SLDEGRFTRI  AGADFNDAGL  GLPGLLASLA  TTGFQASNLG  DAVDVVNQML
Z.mays_1    SLDESRFTRI  AGADFNDPAV  GLEGLLASLA  STGFQASNLG  DAIDVVNQML
S.bicol.    SLDESRFTRI  AGADFNDPGL  GLEGLLASLA  STGFQASNLG  DAIDVVNQML
Z.mays_2    RLDDKRFTRI  AGADFDDAGL  GLAGLLGSLA  STGFQASNLG  DAIDVVNQML
M.acumi.    SLEEKRFPRV  QGYDFN.RGC  DLIGLLDSMS  TTGFQASNLG  DAIDVINQMI
T.cacao     SL.EGKCTKI  EGYDFN.QGV  NYSQLLKSML  STGFQASNLG  EAMEIVNEML
M.longf.    SL.EGASAKI  EGYDFN.KGV  DYPELLKSMA  VTGFQASNLG  DAIHLVNEML
L.sativ.    SL EGSCAKI  QGYDFN TGI  NYSQILKSLI  STGFQASNLG  DAIETVNQML
Consensus   sL.eg.c.k!  eGyDFN..Gv  ny..L$kSm.  .TGFQAsNlG  #A!.vVN#Ml
```

FIG. 1 CONTD.

```
              101                                                              150
H.sapie.    EKKL..EPLS  QDEDQHADLT  QSRRPLTSCT  IFLGYTSNLI  SSGIRETIRY
A.thali.    DWRLADETTV  AEDCSEEEKN  PSFRESVKCK  IFLGFTSNLV  SSGVRDTIRY
C.sativ.    DWRLADETTV  AEDCSEEEKD  PSYRESVKCK  IFLGFTSNLV  SSGVRDTIRY
 B.rapa     EWRLSDETIA  PEDCSEEEKD  PAYRESVKCK  IFLGFTSNLV  SSGVRETIRY
B.napus     EWRLSDETIA  PEDCSEEEKD  PAYRESVKCK  IFLGFTSNLV  SSGVRETIRY
G.hirsu.    DWRLSDEPIA  .EDSSEEEKD  PTYRESVRSK  VFLGFTSNLI  SSGVRDTVRY
P.delto.    DWRLADEEIT  .EDCSDEERE  LAYRESVRCK  LFLGFTSNLV  SSGVRDTIRY
C.sinen.    DWRLSYESLT  .EDCGEEERN  PAYRESMRCK  VFLGFTSNLI  SSGVRDTIRY
V.vinif.    DWRLSDESPA  .EDCSEEERD  EKYRKSVKCK  VFLGFTSNLI  SSGVRDTVRY
M.sativ.    DWRLVDEPID  .EDCDEDKKD  LEYRKSVTCK  VFLGFTSNLI  SSGVRDVVRY
C.ariet.    DWRLVDEPVT  .EDCADEERD  LDYRKSVKCK  VFLGFTSNLI  SSGVRDVVRY
A.duran.    DWRLADEPVV  .DDCSEEERD  LGYRRSVTCK  VFLGFTSNLI  SSGVRDTVRF
A.ipaen.    DWRLADEPVV  .DDCSEEERD  LGYRRSVTCK  VFLGFTSNLI  SSGVRDTVRF
G.max_1     DWRLVDEPVA  .EDCSDQERD  LEYRKSVTCK  VFLGFTSNLI  SSGVRDTVRF
G.max_2     DWRLVDEPVA  .EDCSDQERD  LEYRKSVTCK  VFLGFTSNLI  SSGVRDTVRF
P.vulga.    DWRLVDEAVT  .EDCSDHERD  LEYRKSVTSK  VFLGFTSNLI  SSGVRDIVRF
B.vulga.    DWRLSDEVPA  .EDCSMEESD  SDYRNSVRCK  IFLGFTSNLI  SSGIRDTVRY
S.lycop.    DWRLSHELPT  .EDCSEEERD  VAYRESVTCK  IFLGFTSNLV  SSGVRDTVRY
S.tuber.    DWRLSHELLM  .EDCSEEERD  VAYRESVTCK  IFLGFTSNLV  SSGVRDTVRY
C.canep.    DWRLSDECPT  .EDCSEEERD  PAFRESVRCK  VFLGFTSNLV  SSGVRDTIRY
T.aesti.    DWRLSHEKPT  .EDCDEAELD  PKYRESVKCK  IFLGFTSNLV  SSGIRDVIRF
O.sativ.    DWRLSHEKPR  .EDCDEAELD  PTYRESVKCK  IFLGFTSNLV  SSGIRDVVRF
Z.mays_1    DWRLSHEKPS  .EDCDEAELD  PKYRASVKCK  IFLGFTSNLV  SSGIRDIIRF
S.bicol.    DWRLSHEKPS  .EDCDDAELD  PKYRESVKCK  IFLGFTSNLV  SSGIRDIIRF
Z.mays_2    DWRLSHEKPS  .DDCAEAELD  PAYRESVKCK  IFLGFTSNLV  SSGVREIIRF
M.acumi.    DWRLSHDAPT  .EDCSEEERN  LAYRQSVTCK  IFLGFTSNLV  SSGIREIIRF
T.cacao     DWRLADEAIT  .EDCSEEEKD  PAYRESVRCK  VFLGFTSNLI  SSGLRDTVRY
M.longf.    DWRLSDETPA  .EDCSQEERD  PAHRDSVRCK  VFLGFTSNLI  SSGIRDIIRF
L.sativ.    DWRLSHEQVT   EDCSEEESN  PAYRESVKCK  IFLGFTSNLI  SSGVRDIIRY
Consensus   #WRLsdE...  .#Dcsee#.#  p.yReSv.CK  !FLGFTSNL!  SSG!R#t!R%
```

FIG. 1 CONTD.

```
            151                                                      200
H.sapie.    LVQHNMVDVL VTTAGGVEED LIKCLAPTYL GEFSLRGKEL RENGINRIGN
A.thali.    LVQHHMVDVI VTTTGGVEED LIKCLAPTFK GDFSLPGAYL RSKGLNRIGN
C.sativ.    LVQHHMVDVI VTTTGGVEED LIKCLAPTFK GDFSLPGAYL RSKGLNRIGN
 B.rapa     LVQHHMVDVI VTTTGGVEED LIKCLAPTFK GDFSLPGAYL RSKGLNRIGN
B.napus     LVQHHMVDVI VTTTGGVEED LIKCLAPTFK GDFSLPGAYL RSKGLNRIGN
G.hirsu.    LTEHHMVDVI VTTTGGIEED LIKCLAPTYK GDFSLPGAQL RSRGLNRIGN
P.delto.    LVQHHMVDVV VTTAGGIEED LIKCLAPTYK GDFSLPGAQL RSKGLNRIGN
C.sinen.    LVQHHMVDVV VTTAGGVEED LIKCLAPTYK GDFSLPGAHL RSKGLNRIGN
V.vinif.    LTEHHMVDVV VTTAGGIEED LIKCLAPTYK GDFYLSGTHL RSKGLNRIGN
M.sativ.    LCQHHMVHVV VTTTGGIEED LIKCLAPTYK GEFSLPGAYL RSKGLNRIGN
C.ariet.    LCQHHMVDVI VTTTGGIEED LIKCLAPTYK GDFSLPGAHL RSKGLNRIGN
A.duran.    LVQHHMVDVI VTTTGGIEED LIKCLAPTYK GDFSLDGAYL RSKGLNRIGN
A.ipaen.    LVQHHMVDVI VTTTGGIEED LIKCLAPTYK GDFSLDGAYL RSKGLNRIGN
G.max_1     LLQHRMVDVV VTTTGGIEED LIKCLAPTYK GDFSLPGAYL RSKGLNRIGN
G.max_2     LLQHRMVDVV VTTTGGIEED LIKCLAPTYK GDFSLPGAYL RSKGLNRIGN
P.vulga.    LLQHRMVDVV VTTTGGIEED LIKCLAPTFS GDFSLPGAYL RSKGLNRIGN
B.vulga.    LVQNHMVHVI ATTAGGIEED LIKCLAPTFR GEFSLPGAQL RSKGLNRIGN
S.lycop.    LVQHRMVDVV VTTAGGIEED LIKCLAPTYK GDFSLPGASL RSKGLNRIGN
S.tuber.    LVQHRMVDVV VTTAGGIEED LIKCLAPTYK GDFSLSGAAL RSKGLNRIGN
C.canep.    LVQHHMVDVV VTTAGGVEED LIKCLAPTYK GDFSLPGAAL RSKGLNRIGN
T.aesti.    LVQHHMVDVV VTTAGGIEED LIKCLAPTYR GEFSLPGALL RSKGLNRIGN
O.sativ.    LVQHHMVDVI VTTAGGIEED LIKCLAPTYR GEFSLPGTLL RSKGLNRIGN
Z.mays_1    LAQHHMVDVI VTSAGGIEED LIKCLAPTYR GDFSLPGALL RSKGLNRIGN
S.bicol.    LAQHHMVDVI VTSAGGIEED LIKCLAPTYR GDFSLPGALL RSKGLNRIGN
Z.mays_2    LVQHRMVDVI VTTAGGIEED LIKCLAPTYR GDFTLPGALL RSRGLNRIGN
M.acumi.    LVQHRMVEVL VTTAGGIEED LIKCLAPTYK GDFSLPGSYL RSKGLNRIGN
T.cacao     LTEHHMVDVI VTTTGGIEED LIKCLAPTYK GDFYLPGAQL RSRGLNRIGN
M.longf.    LVQHRMVDVV VTTAGGVEED LVKCLAPTYR GDFSLPGAVL RSKGLNRIGN
L.sativ.    LTQHHMVDVI VTTTGGIEED LIKCLADTYR GEFSLPGAAL RSKGLNRIGN
Consensus   Lv#HhMV#V. VTTaGG!EED LIKCLAPT%k G#FsLpGa.L RSkGLNRIGN
```

FIG. 1 CONTD.

```
             201                                              250
H.sapie.  LLVPNENYCK FEDWLMPILD QMVMEQNTEG VKWTPSKMIA RLGKEINNPE
A.thali.  LLVPNDNYCK FEDWIIPIFD EMLKEQKEEN VLWTPSKLLA RLGKEINNES
C.sativ.  LLVPNDNYCK FEDWIIPIFD EMLKEQKEEN VLWTPSKLLA RLGKEINNES
 B.rapa   LLVPNDNYCK FEDWIIPIFD QMLKEQKEES VLWTPSKLLA RLGKEINNES
B.napus   LLVPNDNYCK FEDWIIPIFD QMLKEQKEEN VLWTPSKLLA RLGKEINNES
G.hirsu.  LLVPNDNYCK FEDWIIPIFD QMLKEQHEEN VLWTPSKLIA RLGQEINNGD
P.delto.  LLVPNDNYCK FEDWIIPIFD QMLKEQIEEN ITWTPSKLIA RMGKEINNES
C.sinen.  LLVPNENYCK FEDWIIPIFD QMLEEQTAKN VLWTPSKVIA RLGKEINNES
V.vinif.  LLVPNDNYCK FEDWIIPIFD QMLKEQTSEN VLWTPSKVIA RLGKEINNES
M.sativ.  LLVPNENYCK FEDWIIPIFD QMLKEQKEEK VLWTPSKLIA RLGKEINNEN
C.ariet.  LLVPNDNYCK FEDWIIPIFD QMLREQNNEN VLWTPSKLIA RLGKEINDES
A.duran.  LLVPNDNYCK FEDWIIPIFD QMLTEQNNEN VIWTPSKLIA RLGKEIKNES
A.ipaen.  LLVPNDNYCK FEDWIIPIFD QMLTEQNNEN VIWTPSKLIA RLGKEIKNES
G.max_1   LLVPNDNYCK FEDWIIPIFD QMLGEQNNEN VLWTPSKLIA RLGKEIKNES
G.max_2   LLVPNDNYCK FEDWIIPIFD QMLGEQNNEN VLWTPSKLIA RLGKEIKNES
P.vulga.  LLVPNDNYCK FEDWIIPIFD QMLKEQNTEN VLWTPSKLIA RLGKEINNES
B.vulga.  LLVPNDNYCK FEDWIIPIFD KMLKEQNSEK ITWTPSKVIA RLGKEIDDES
S.lycop.  LLVPNDNYCK FENWIIPVFD QMYEEQINEK VLWTPSKVIA RLGKEINDET
S.tuber.  LLVPNDNYCK FENWIIPIFD QMYEEQINEK VLWTPSKVIA RLGKEINDET
C.canep.  LLVPNNNYCK FEDWIIPIFD KMLEEQTSKN MLWTPSKVIS RLGKEINDES
T.aesti.  LLVPNDNYCK FENWIMPLFD QMLQEQSTEN V.WTPSKVIA RLGKEINDES
O.sativ.  LLVPNDNYCK FENWIMPLFD QMLQEQSTEN V.WTPSKVIA CLGKEINDES
Z.mays_1  LLVPNDNYCK FENWIMPLFD QMLQEQSTEN V.WTPSKVIA RLGKEINDES
S.bicol.  LLVPNDNYCK FENWIMPLFD QMLLEQSTEN V.WTPSKVIA RLGKEINDES
Z.mays_2  LLVPNDNYCK FEHWIMPILD KMLLEQSTQN V.WTPSKVIA RLGKEINDES
M.acumi.  LLVPNDNYCK FEDWIMPILD QMLLEQTTEN VVWTPSKVIA RLGKEINDES
T.cacao   LLVPNDNYCK FEDWIIPIFD QMLKEQLEE. .......... ..........
M.longf.  LLVPNDNYCK FEDWIIPVFD QMLDEQNSQN VLWTPSKLIA CLGKEINDET
L.sativ.  LLVPNDNYCK FEDWIIPIFD QMLQEQNTQH VLWTPSKVIS RLGKEINNES
Consensus LLVPN#NYCK FE#WIiPifD qMl.EQ..#n vlWTPSK.ia r$GkEIn#es
```

FIG. 1 CONTD.

```
              251                                                    300
H.sapie.   SVYYWAQKNH IPVFSPALTD GSLGDMIFFH SYK....... ..NPGLVLDI
A.thali.   SYLYWAYKMN IPVFCPGLTD GSLGDMLYFH SFR....... ..TSGLIIDV
C.sativ.   SYLYWAYKMN IPVFCPGLTD GSLGDMLYFH SFR....... ..TSGLVIDV
 B.rapa    SYLYWAYKMN IPVFCPGLTD GSLGDMLYFH SFR....... ..TSGLVIDV
B.napus    SYLYWAYKMN IPVFCPGLTD GSLGDMLYFH SFR....... ..TSGLVIDV
G.hirsu.   SYLYWAYKNN IPVFCPGLTD GSLGDMLYFH SFR....... ..NPGLIIDV
P.delto.   SYLYWAYKND IPVFCPGLTD GSLGDMLYFH SFH....... ..NPGLIVAI
C.sinen.   SYLYWAYKNN IPVFCPGLTD GSLGDMLYFH SFR....... ..NPGLVVDV
V.vinif.   SYLYWAYKNN IPVFCPGLTD GSLGDMLYFH SFR....... ..NPGLIIDI
M.sativ.   SYLYWAYKNN IPVYCPGLTD GSLGDMLYFH SFH....... ..NPGLIVDI
C.ariet.   SYLYWAYKNN IPVFCPGLTD GSLGDMLYFH SFH....... ..NPGLIVDI
A.duran.   SYLYWAYKNN IPVFCPGLTD GSLGDMLYFH SFR....... ..NPGLIVDI
A.ipaen.   SYLYWAYKNN IPVFCPGLTD GSLGDMLYFH SFR....... ..NPGLIVDI
G.max_1    SYLYWAYKNN IPVFCPGLTD GSLGDMLYFH SFR....... ..NPGLIVDI
G.max_2    SYLYWAYKNN IPVFCPGLTD GSLGDMLYFH SFR....... ..NPGLIVDI
P.vulga.   SYLYWAYKNN IPVFCPGLTD GSLGDMLYFH SFR....... ..NPGLIVDI
B.vulga.   SYLYWAYKNN IPVFCPGLTD GSLGDMLYFH SFR....... ..NPGLIIDI
S.lycop.   SYLYWAYKNR IPVFCPGLTD GSLGDMLYFH SFKKGDPDNP DLNPGLVIDI
S.tuber.   SYLYWAYKNR IPVFCPGLTD GSLGDMLYFH SFKKGDPD.. .LNPGLVIDV
C.canep.   SYLYWAYKNN IPVFCPGLTD GSLGDMLYFH SFR....... ..NPGLVIDI
T.aesti.   SYLYWAYKNN IPVYCPALTD GSLGDMLFCH AVR....... ..NPGLIIDI
O.sativ.   SYLYWAYKNN IPVYCPALTD GSLGDMLFCH AVR....... ..NPGLIIDI
Z.mays_1   SYLYWAYKNN IPVYCPALTD GSLGDMLFCH AVR....... ..NPGLIIDI
S.bicol.   SYLYWAYKNN IPVYCPALTD GSLGDMLFCH AVR....... ..NPGLIIDI
Z.mays_2   SYLYWAYKNN IPVFCPALTD GSIGDMLFCH SVH....... ...SPGLVVDI
M.acumi.   SYLYWAYKNN VSVYCPALTD GSLGDMLYCH SVR....... ..NPGLLIDI
T.cacao    ........NE IPVFCPGLTD GSLGDMLYFH SFH....... ..SPGLIIDV
M.longf.   SYLYWAYKNN IPVFCPGLTD GSLGDMLYFH SFK....... ..NPGLVVDI
L.sativ.   SYLYWAYKND IPVFCPGLTD GSLGDMLYFH SFR....... ..NPGLVIDV
Consensus  SylYWAyKNn IPV%CPgLTD GSLGDML%fH sfr....... ..nPGL!!D!
```

FIG. 1 CONTD.

```
            301                                                      350
H.sapie.   VE........ ........DL RLINTQAIFA ..KCTGMIIL GGGVVKHHIA
A.thali.   VQ........ ........DI RAMNGEAVHA NPKKTGMIIL GGGLPKHHIC
C.sativ.   VQ........ ........DI RAMNGEAVHA SPRKTGMIIL GGGIPKHHIC
 B.rapa    VQ........ ........DI RAMNGEAVHA TPRKTGMIIL GGGLPKHHIC
B.napus    VQ........ ........DI RAMNGEAVHA TPRKTGMIIL GGGLPKHHIC
G.hirsu.   VQ........ ........DI RAMNGEAVHA SPRKTGMIIL GGGLPKHHIC
P.delto.   VQ........ ........DI RAMNGEAVHA SPRKTGIIIL GGGLPKHHIC
C.sinen.   VQVYDNLGNE LMTLALYIDI RAMNGEAVHA SPRKTGMIIL GGGLPKHHIC
V.vinif.   VQ........ ........DI RAMNGEAVHA NPRKTGMIIL GGGMPKHHIC
M.sativ.   VQ........ ........DI RAMNGEAVHA NPSKTGMIIL GGGLPKHHIC
C.ariet.   VR........ ........DI RAVNGEAVHA NPRKTGIIIL GGGLPKHHIC
A.duran.   VQ........ ........DI RAMNGEAVHA SPRKTGMIIL GGGLPKHHIC
A.ipaen.   VQ........ ........DI RAMNGEAVHA SPRKTGMIIL GGGLPKHHIC
G.max_1    VQ........ ........DI RAMNGEAVHA SPRKTGMIIL GGGLPKHHIC
G.max_2    VQ........ ........DI RAMNGEAVHA SPRKTGMIIL GGGLPKHHIC
P.vulga.   VQ........ ........DI RAMNGEAVHA NPRKTGMIIL GGGLPKHHIC
B.vulga.   VQ........ ........DI RAMNGEAVHA APRKTGVIVL GGGLPKHHIC
S.lycop.   VG........ ........DI RAMNGEAVHA GLRKTGMIIL GGGLPKHHVC
S.tuber.   VG........ ........DI RAMNGEAVHA GLRKTGMIIL GGGLPKHHIC
C.canep.   VQ........ ........DI RNMNGEAVHV GLRKTGMIIL GGGLPKHHIC
T.aesti.   VQ........ ........DI RLINGEAIHA SPRKTGVIIL GGGLPKHHIC
O.sativ.   VQ........ ........DI RLMNGEAIHA TPRKTGIIVL GGGLPKHHIC
Z.mays_1   VQ........ ........DI RLMNGEAIHA TPRKTGIIVL GGGLPKHHIC
S.bicol.   VQ........ ........DI RLMNGEAIHA TPRKTGIIVL GGGLPKHHIC
Z.mays_2   VQ........ ........DV RLMNAETIHA SPRKTGIILL GGGLPKHHIC
M.acumi.   VQ........ ........DI RAMNGEAIHV GLRKTGVIIL GGGLPKHHIC
T.cacao    VQ........ ........DI RAMNSEAVHA SPRKTGMIIL GGGLPKHHIC
M.longf.   VQ........ ........DI RAMNGEAVHA GQRKTGMIIL GGGLP.....
L.sativ.   VQ........ ........DI RAINSEAVHA NPRKTGMIIL GGGLPKHHIC
Consensus  V#........ ........D! RamNgEA!HA .prKTGmI!L GGG$PKHH!c
```

FIG. 1 CONTD.

```
              351                                              400
H.sapie.   NANLMRNGAD YAVYINTAQE F GSDSGARP D EAVS GK R VDAQPV VYA
A.thali.   NANMMRNGAD YAVFINTGQE F GSDSGARP D EAVS GK R GSAKTV VYC
C.sativ.   NANMMRNGAD YAVFINTGQE F GSDSGARP D EAVS GK R GSAKTV VYC
 B.rapa    NANMMRNGAD YAVFINTGQE F GSDSGARP D EAVS GK R GSAKTV VYC
B.napus    NANMMRNGAD YAVFINTGQE F GSDSGARP D EAVS GK R GSAKTV VYC
G.hirsu.   NANMMRNGAD YAVYINTAQE Y GSDSGARP D EAVS GK R GSAKTV VHC
P.delto.   NANMMRNGAD YAVFINTAQE F GSDSGAHP D EAVS GK R GSAKTV VHC
C.sinen.   NANMMRNGAD YAVFINTAQE F GSDSGARP D EAVS GK R GSAKTV VHC
V.vinif.   NANMMRNGAD YAVFINTAQE F GSDSGARP D EAVS GK R GSAMTV VHC
M.sativ.   NANMMRNGAD YAVFINTAQE F GSDSGARP D EAVS GK R GSAKTV VHC
C.ariet.   NANMMRNGAD YAVFINTAQE F GSDSGARP D EAVS GK R GSAKTV VHC
A.duran.   NANMMRNGAD YAVFINTAQE F GSDSGARP D EAVS GK R GSAKTV VHC
A.ipaen.   NANMMRNGAD YAVFINTAQE F GSDSGARP D EAVS GK R GSAKTV VHC
G.max_1    NANMMRNGAD YAVFINTAQE Y GSDSGARP D EAVS GK R DSAQTV VHC
G.max_2    NANMMRNGAD YAVFINTAQE Y GSDSGARP D EAVS GK R DSAQTV VHP
P.vulga.   NANMMRNGAD YAVFINTAQE Y GSDSGARP D EAVS GK R GSAKTV VHC
B.vulga.   NANMMRNGAD YAVFVNTAQE F GSDSGARP D EAVS GK R GSAKTV VHC
S.lycop.   NANMMRNGAD FAVFINTAQE F GSDSGARP D EAVS GK R GGAKTV VHC
S.tuber.   NANMMRNGAD FAVFINTAQE F GSDSGARP D EAVS GK R GGAKTV VHC
C.canep.   NANMMRNGAD FAVFINTAQE Y GSDSGARP D EAVS GK R GSAKAV VHC
T.aesti.   NANMFRNGAD YAVYINTAQE F GSDSGARP D EAVS GK K GSAKPV VHC
O.sativ.   NANMFRNGAD YAVYINTAQE F GSDSGAQP D EAVS GK K GSAKPV VHC
Z.mays_1   NANMFRNGAD YAVYINTAQE F GSDSGAHP D EAVS GK K GSAKPV VHC
S.bicol.   NANMFRNGAD YAVYINTAQE F GSDSGAHP D EAVS GK K GSAKPV VHC
Z.mays_2   NANMLRDGAD YAVYVNTAQE F GSDSGARP D EAVS GK K SSARTV VHC
M.acumi.   NANMFRNGAD YAVYVNTAQE F GSDSGAQP D EAIS GK K GSAKTI VHC
T.cacao    NANMMRNGAD YAVYINTAQE F GSDSGARP D EAIS GK R GSARTV....
M.longf.   .......... .......... .......... .......... ..........
L.sativ.   NANMMRNGAD YAVFINTAQE F GSDSGARP D EAVS GK IR GSAKSV VHC
Consensus  NAN$mR#GAD %AV%!NTaQE %DGSDSGArP DEA!SWGKIr gsAkt!kvhc
```

FIG. 1 CONTD.

```
              401              428
H.sapie.   DASLVFPLLV AETFAQKMDA FMHEKNED     (SEQ ID NO: 10)
A.thali.   DATIAFPLLV AETFATKRDQ TCESKT..     (SEQ ID NO: 11)
C.sativ.   DATIAFPLLV AETFATKREQ TCESKT..     (SEQ ID NO: 44)
 B.rapa    DATIAFPLLV AETFASKREQ NCEHKT..     (SEQ ID NO: 36)
B.napus    DATIAFPLLV AETFASKREQ NCEHKT..     (SEQ ID NO: 38)
G.hirsu.   DATIAFPLLV AETFASRSKN FVA.....     (SEQ ID NO: 32)
P.delto.   DATIAFPLLV AETFAPRRNR FCSSTQS.     (SEQ ID NO: 46)
C.sinen.   DATIAFPLLV AETFAARGKR SAENES..     (SEQ ID NO: 54)
V.vinif.   DATIAFPLLV AETFAAKISK PL......     (SEQ ID NO: 52)
M.sativ.   DATIAFPLLV AETFASRTSP LN......     (SEQ ID NO:  2)
C.ariet.   DATIAFPLLV AETFASKTKR HH......     (SEQ ID NO: 50)
A.duran.   DATIAFPLLV AETFAPRVKP CNQ.....     (SEQ ID NO: 18)
A.ipaen.   DATIAFPLLV AETFAPRVKP CNQ.....     (SEQ ID NO: 20)
G.max_1    DATIAFPLLV AETFASRVKP HH......     (SEQ ID NO: 22)
G.max_2    MQTFTTGFLV IVL....... ........     (SEQ ID NO: 24)
P.vulga.   DATIAFPLLV AETFASRVKP HH......     (SEQ ID NO: 48)
B.vulga.   DATIAFPLLV AETFAAKRKN ........     (SEQ ID NO: 34)
S.lycop.   DATIAFPILV AETFAAKSKE FSQIRCQV     (SEQ ID NO: 12)
S.tuber.   DATIAFPILV AETFAAKSKE FSQIRCQV     (SEQ ID NO: 42)
C.canep.   DATIAFPLLV AETFATKVK. ........     (SEQ ID NO: 56)
T.aesti.   DATIAFPLLV AATFARRSHG ANSTN...     (SEQ ID NO: 13)
O.sativ.   DATIAFPLIV AATFARKFHG AKQAN...     (SEQ ID NO: 30)
Z.mays_1   DASIAFPLLV AATFARKVHN SK......     (SEQ ID NO: 26)
S.bicol.   DASIAFPLLV AATFARKVHS SK......     (SEQ ID NO: 40)
Z.mays_2   DATIAFPLLV AATFARKVHG TKSTN...     (SEQ ID NO: 28)
M.acumi.   DATIAFPLLV AATFARKFQE RNNKLA..     (SEQ ID NO: 14)
T.cacao    .......... .......... ........     (SEQ ID NO: 53)
M.longf.   .......... .......... ........     (SEQ ID NO: 55)
L.sativ.   DATIAFPLLV AETFAAKREG EMKNVEST KALV  (SEQ ID NO: 64)
Consensus  datiafpllv aetfa.k... ........     (SEQ ID NO: 51)
```

FIG. 1 CONTD.

```
   1 GGTTGTGTCT TTTTCCCTGT CTGCTAGCTT GCTAGAACCC TAAAACTCCC
  51 TCCCAAAACT CTCCACATCT TCCGAGAAAG AAGATGGAGG AGGATCGTGT
 101 TCTCTCATCT GTTCACTCCA CCGTCTTCAA GGAATCAGAA TCGTTGGAAG
 151 GAAAGTGCGA CAAAATCGAA GGATACGATT CAACCAAGG AGTAAACTAC
 201 CCGAAGCTTC TCCGATCCAT GCTCACAACC GGCTTCCAAG CCTCGAATCT
 251 CGGCGAAGCT ATTGATATCG TTAATCAAAT GCTAGAGTGG AGACTCTCTG
 301 ATGAAACTAT AGCACCTGAA GACTGTAGTG AAGAGGAGAA GGATCCAGCG
 351 TATAGAGAGT CCGTGAAGTG TAAAATCTTT CTAGGCTTCA CTTCGAATCT
 401 TGTTTCGTCT GGTGTTAGAG AGACTATTCG ATACCTTGTT CAGCATCATA
 451 TGGTTGATGT TATAGTTACT ACAACTGGTG GCGTAGAGGA AGATCTTATC
 501 AAATGCCTTG CTCCTACTTT CAAAGGTGAC TTCTCTCTAC CGGGTGCGTA
 551 TCTTCGGTCA AAGGGATTNA ACCGGATCGG GAACTTGCTT GTTCCGAATG
 601 ATAACTACTG CAAGTTTGAG GATTGGATCA TTCCCATCTT TGACCAGATG
 651 TTGAAGGAAC AGAAAGAAGA GAATGTGTTG TGGACACCTT CTAAACTGTT
 701 AGCGCGTTTG GGAAAAGAAA TAAACAATGA GAGTTCATAC CTTTATTGGG
 751 CATACAAGAT GAATATTCCA GTATTCTGCC CGGGGTTAAC AGATGGCTCT
 801 CTCGGTGATA TGCTCTATTT TCACTCCTTT CGTACCTCTG GCCTTGTCAT
 851 CGATGTTGTG CAAGATATCA GAGCTATGAA CGGAGAAGCT GTCCATGCTA
 901 CTCCAAGAAA GACAGGGATG ATAATCCTCG GAGGCGGCTT GCCGAAGCAC
 951 CACATATGTA ATGCCAACAT GATGCGTAAC GGTGCGGACT ACGCTGTGTT
1001 CATAAACACA GGGCAAGAGT TTGATGGGAG TGACTCTGGT GCACGCCCTG
1051 ATGAAGCAGT GTCTTGGGGT AAAATAAGGG GGTCTGCTAA AACCGTTAAG
1101 GTATACTGTG ATGCTACCAT AGCCTTTCCT TTGTTGGTTG CTGAAACATT
1151 TGCCTCCAAG AGAGAACAAA ACTGTGAGCA CAAGACCTAA GCCCAAGAAA
1201 GCTTACGTCT CTTTTATCGG TTTGTTCTTC CATCTTGTTG TTGTACCCTT
1251 TGTCCTGCTT TACATAACAT TCATCTCTAA AACAATACTA CCTCCTTTTG
1301 ACAAAAAATA AAAAAATTG GAAAATGGT TTCACAAGAA TAATATTTTT
1351 GTGTGCTCAA TAAATTTTGT ATTATTTAAT GACAGTAAA
```

FIG. 4

GE0568 – DHS-1 Rice Callus

| Sequence | ID | Δ | SEQ ID NO |
|---|---|---|---|
| GCATTGATATCTTATCCCTATGATGTAGCTAATCCCCCTTGAAAAATGTG | WT | | 533 |
| GCATTGATATCTTATCC---------AGCTAATCCCCCTTGAAAAATGTG | C7 | -9bp | 534 |
| GCATTGATATCTTATCCC----------CTAATCCCCCTTGAAAAATGTG | C39 | -10bp | 535 |
| GCATTGATATCTTATCCCTA-------GCTAATCCCCCTTGAAAAATGTG | C39 | -7bp | 536 |
| GCATTGATATCTTATCCCTATG---TAGCTAATCCCCCTTGAAAAATGTG | C47 | -3bp | 537 |
| GCATTGATATCTTATCCC---------GCTAATCCCCCTTGAAAAATGTG | C47 | -9bp | 538 |
| GCATTGATATCT--------------------//---------CTGCTGG | C125 | -65bp | 539 |

FIG. 6

GE0568 – DHS-1 T0 Rice Plants

| Sequence | ID | Δ | SEQ ID NO |
|---|---|---|---|
| GCATTGATATCTTATCCCTATGATGTAGCTAATCCCCCTTGAAAAATGTG | WT | | 533 |
| GCATTGATATCTTAT---------------------CCTTGAAAAATGTG | C8Q | -21bp | 540 |
| GCATTGATATCTTATCC-------GTAGCTAATCCCCCTTGAAAAATGTG | C8R | -7bp | 541 |
| GCATTGATATCTTATCCC------------------CCTTGAAAAATGTG | C39J | -18bp | 542 |
| GCATTGATATCTTATCCCTATGA---AGCTAATCCCCCTTGAAAAATGTG | C30T | -3bp | 543 |
| GCATTGATATCTTATCCC--insert---CTAATCCCCCTTGAAAAATGTG | C30S | -10bp +98bp | 544 |
| GCATTGATATCTTATCCCTATGATGTAGCTAATCCCCCTTGAAAAATGTG | C59 | 0bp | 545 |

FIG. 7

PLANTS WITH MODIFIED DEOXYHYPUSINE SYNTHASE GENES

BACKGROUND OF THE INVENTION

Senescence is the terminal phase of biological development in the life of a plant. It presages death and occurs at various levels of biological organization including the whole plant, organs, flowers and fruit, tissues and individual cells.

The onset of senescence can be induced by different factors both internal and external. Senescence is a complex, highly regulated developmental stage in the life of a plant or plant tissue, such as fruit, flowers and leaves. Senescence results in the coordinated breakdown of cell membranes and macromolecules and the subsequent mobilization of metabolites to other parts of the plant.

In addition to the programmed senescence which takes place during normal plant development, death of cells and tissues and ensuing remobilization of metabolites occurs as a coordinated response to external, environmental factors. External factors that induce premature initiation of senescence, which is also referred to as necrosis or apoptosis, include environmental stresses such as temperature, drought, poor light or nutrient supply, as well as pathogen attack. Plant tissues exposed to environmental stress also produce ethylene, commonly known as stress ethylene [Buchanan-Wollaston (1997) J. Exp. Botany 48:181-199; Wright, M. (1974) Plant 120:63-69]. Ethylene is known to cause senescence in some plants.

Senescence is not a passive process, but, rather, is an actively regulated process that involves coordinated expression of specific genes. During senescence, the levels of total RNA decrease and the expression of many genes is switched off [Bate et al. (1991) J. Exper. Botany 42:801-11; Hensel et al. (1993) The Plant Cell 5:553-64]. However, there is increasing evidence that the senescence process depends on de novo transcription of nuclear genes. For example, senescence is blocked by inhibitors of mRNA and protein synthesis and enucleation. Molecular studies using cDNA from senescing leaves and green leaves for in vitro translation experiments show a changed pattern of leaf protein products in senescing leaves [Thomas et al. (1992) J. Plant Physiol. 139:403-12]. With the use of differential screening and subtractive hybridization techniques, many cDNA clones representing senescence-induced genes have been identified from a range of different plants, including both monocots and dicots, such as *Arabidopsis*, maize, cucumber, asparagus, tomato, rice and potato. Identification of genes that are expressed specifically during senescence is hard evidence of the requirement for de novo transcription for senescence to proceed.

The events that take place during senescence appear to be highly coordinated to allow maximum use of the cellular components before necrosis and death occur. Complex interactions involving the perception of specific signals and the induction of cascades of gene expression must occur to regulate this process. Expression of genes encoding senescence related proteins is probably regulated via common activator proteins that are, in turn, activated directly or indirectly by hormonal signals. Little is known about the mechanisms involved in the initial signaling or subsequent co-ordination of the process.

Coordinated gene expression requires factors involved in transcription and translation, including initiation factors. Translation initiation factor genes have been isolated and characterized in a variety of organisms, including plants. Translation initiation factors can control the rate at which mRNA populations are moved out of the nucleus, the rate at which they are associated with a ribosome and to some extent can affect the stability of specific mRNAs. [Zuk et al. (1998) EMBO J. 17:2914-2925]. Indeed, one such translation initiation factor, which is not required for global translation activity, is believed to shuttle specific subsets of mRNAs from the nucleus to the cytoplasm for translation [Jao et al. (2002) J. Cell. Biochem. 86:590-600; Wang et al. (2001) J. Biol. Chem. 276:17541-17549; Rosorius et al. (1999) J. Cell Sci. 112:2369-2380]. This translation factor is known as the eukaryotic initiation factor 5A (eIF-5A), and is the only protein known to contain the amino acid hypusine [Park et al. (1988) J. Biol. Chem. 263:15264-15269].

Eukaryotic translation initiation factor 5A (eIF-5A) is an essential protein factor approximately 17 kDa in size, which is involved in the initiation of eukaryotic cellular protein synthesis. It is characterized by the presence of hypusine [N-(4-amino-2-hydroxybutyl)lysine], a unique modified amino acid and known to be present only in eIF-5A. Hypusine is formed post-translationally via the transfer and hydroxylation of the butylamine group from the polyamine, spermidine, to the side chain amino group of a specific lysine residue in eIF-5A. Activation of eIF-5A involves transfer of the butylamine residue of spermidine to the lysine of eIF-5A, forming hypusine and activating eIF-5A. In eukaryotes, deoxyhypusine synthase (DHS) mediates the post-translational synthesis of hypusine in eIF-5A. The hypusine modification has been shown to be essential for eIF-5A activity in vitro using a methionyl-puromycin assay.

Hypusine is formed on eIF-5A post-translationally through the conversion of a conserved lysine residue by the action of deoxyhypusine synthase (DHS; EC 1.1.1.249) and deoxyhypusine hydroxylase (DOHH; EC 1.14.99.29). DHS cDNA has been directly sequenced or predicted from genomic sequences in dozens of plant species, including *Arabidopsis thaliana* (GenBank Accession No. NM_120674), alfalfa (U.S. Pat. No. 8,563,285), banana (GenBank Accession No. XM_009405857), *Camelina* (GenBank Accession No. XP_010452500), canola (GenBank Accession No. XM_013859772), carnation (GenBank Accession No. AF296080), cocoa (GenBank Accession No. CGD0006914), coffee (GenBank Accession No. GR986281), soybean (GenBank Accession No. BM092515), tobacco (GenBank Accession No. NM_001325620), tomato (GenBank Accession No. NM_001247566), wheat (GenBank Accession No. FJ376389), and many others. DOHH cDNA sequences have also been identified in some plants, including *Medicago truncatula* (GenBank Accession No. XM_013594404).

DHS converts a conserved lysine residue of eIF-5A to deoxyhypusine through the addition of a butylamine group derived from spermidine. This intermediate form of eIF-5A is then hydroxylated by DHH to become hypusine [Park et al. (1997) Biol. Signals 6:115-123]. Both the deoxyhypusine and the hypusine form of eIF-5A are able to bind cDNA in vitro [Liu et al. (1997) Biol. Signals 6:166-174]. Although the function of eIF-5A is not fully understood, there is some evidence that it may regulate cell division [Park et al. (1998) J. Biol. Chem. 263:15264-15269; Tome et al. (1997) Biol. Signals 6:150-156], and senescence. [Wang et al. (2001) J. Biol. Chem. 276:17541-17549]. It appears that several organisms are known to have more than one isoform of eIF-5A, which would suit the premise that each isoform is a specific shuttle to specific suites of mRNAs that are involved in such processes as cell division and senescence.

Wang et al. demonstrated that an increased level of DHS cDNA correlates with fruit softening and natural and stress-induced leaf senescence of tomato [Wang et al. (2001) J. Biol. Chem. 276:17541-17549; (2003) Plant Molecular Biology 52: 1223-1235; and (2005) Plant Physiology 138: 1372-1382]. Furthermore, when the expression of DHS was suppressed in transgenic tomato plants by introducing a DHS antisense cDNA fragment under the regulation of a constitutive promoter, the tomato fruit from these transgenic plants exhibited dramatically delayed senescence as evidenced by delayed fruit softening and spoilage. See U.S. Pat. Nos. 6,878,860, 6,900,368, 7,070,997, and 7,226,784. Since DHS is known to activate eIF-5A, these data suggest that the hypusine-modified eIF-5A (active eIF-5A) may regulate senescence through selective translation of mRNA species required for senescence. This is further demonstrated through the down-regulation of DHS in *Arabidopsis thaliana* ("AT") by antisense of the full length or 3'UTR cDNA under the control of a constitutive promoter. By down regulating *Arabidopsis thaliana* DHS ("AT-DHS") expression and making it less available for eIF-5A activation, senescence was delayed by approximately 2 weeks [See Duguay et al. (2007) Journal of Plant Physiology 164:408-420 & U.S. Pat. No. 7,226,784]. Not only was senescence delayed, but also an increase in seed yield, an increase in stress tolerance and an increase in biomass were observed in the transgenic plants, where the extent of each phenotype was determined by the extent of the down-regulation of DHS.

Although down-regulation of DHS in plants by means of antisense transgenic plants is expected to generate plants with advantageous agronomic properties, such as resistance to stress, delayed senescence, and increased yields, transgenic plants in general have several disadvantages. Creation of transgenic DHS plants requires the introduction of foreign DNA, including the antisense gene, which often use viral promoters for strong expression, as well as selection genes. Furthermore, viral promoters are often recognized by the plant and turned-off, leading to loss of antisense expression in future generations of transgenic plants. A better strategy for down-regulation of DHS in plants, for instance alfalfa, is to use genome editing to modify the gene in order reduce or eliminate the activity of the translated DHS protein. Tomato, *Arabidopsis thaliana* and many other plants only have one copy of DHS in their genome, as shown by Southern blot [Wang et al. (2001) J. Biol. Chem. 276:17541-17549] and full genome sequencing. Since alfalfa is a tetraploid plant, using a genome editing technique could disrupt in separate progeny from the same experiment: one out of the four DHS copies found in its genome thereby reducing DHS activity in the plant tissues by approximately 25%, two out of the four DHS copies found in its genome thereby reducing activity by approximately 50%, or three out of the four DHS copies found in its genome thereby reducing activity by approximately 75%. Screening independent progeny expressing each of these residual activity levels could lead to identification of clones that demonstrate the maximum degree of improved resistance to stress and delayed senescence via incomplete hypusination of eIF-5A isoforms involved in stress and senescence pathways. It is unlikely to find progeny that have all four DHS copies disrupted since this should be a lethal event, given that homozygous knockout of DHS has been demonstrated to be lethal in mice and yeast [Templin et al. (2011) Cell Cycle 10:1043-9; Sasaki et al. (1996) FEBS Lett. 384:151-4].

Genome editing makes use of various technologies to manipulate the genome of either plants or animals by inserting, deleting, or substituting specific genetic sequences in a highly specific manner. Many genome editing methods exist, and include, but are not limited to, use of transgenic DNA sequences flanked by sequences homologous to the intended site of modification (homologous recombination), or methods using engineered nucleases, including Meganucleases, zinc finger nucleases, (ZFNs), CRISPR-Cas9, CRISPR-Cms1, transcription activator-like effector-based nucleases (TALEN), and ARC nuclease (ARCUS). In all these systems, nucleases create site-specific double-stranded DNA breaks which are then repaired via homologous recombination or nonhomologous end-joining to create the desired mutation.

An example of homologous recombination is the rapid trait development system (RTDS) [Beetham et al. (1999) Proc. Natl. Acad. Sci. USA 96:8774-8778; Kochevenko and Willmitzer (2003) Plant Physiol. 132:174-184]. RTDS uses a Gene Repair Oligonucleotide (GRON) to introduce a mismatch error into the sequence of a targeted gene in a highly specific manner. This mismatch is then repaired by the plant's natural DNA repair system that uses the GRON as a template in order to create the desired modification.

The clustered regularly interspaced short palindromic repeats (CRISPR)/Cas9 genome editing system has been used in a wide variety of organisms, including monocot and dicot plants. One or more single guide RNA (sgRNA), with a target sequence homologous to the desired gene being targeted for editing, is introduced along with Cas9 nuclease, and are used to direct the Cas9 protein to a specific genomic site [reviewed by Ma and Liu (2016) Curr. Protoc. Mol. Biol, DOI: 10.1002/cpmb.10]. Similar experiments can be designed using other double stranded nucleases, such as Cms1 [Begemann and Gray, U.S. Pat. No. 9,896,696].

Transcription activator-like effectors (TALE) are naturally occurring transcription effectors that use a simple code of tandem repeats that allows for customizable generation of TALEs that recognize a DNA sequence with high specificity. When combined with a functional domain, such as FokI nuclease (TALEN), targeted gene disruption is possible. Binding of the TALEN nuclease to its engineered recognition sequence results in double-stranded DNA break and subsequent recruitment of the nonhomologous end joining repair machinery, resulting in either small deletions or insertions that lead to disrupted gene function. TALEN has been used to modify economically important food crops and biofuels and is being explored in correcting genetic errors that underpin certain human diseases. TALEN can also be combined with the simultaneous introduction of a targeting segment of DNA that contains homology to the cleavage site in order to specifically introduce the targeted sequences into the locus using homologous recombination.

Meganucleases (also called homing endonucleases) are nucleases that recognize large sequences (12-40 base pairs) that occur very rarely, and ideally only once, in the genome [Porteus et al. (2005) Nat. Biotechnol. 23:967-73]. Meganucleases normally recognize palindromic sequences, however, by producing a pair of monomers which recognize two different half-sites which, as heterodimers, form a meganuclease that cleaves a non-palindromic site. ARCUS is a genome editing technology that is based on ARC nuclease, a totally synthetic homing endonuclease-like enzyme that is derived from a naturally occurring homing endonuclease. ARC nuclease can be customized to recognize a specific DNA sequence, allowing a precise DNA break, often at only a single site in the genome. This DNA break allows genome modification, including insertions, deletions, or substitutions, by homologous recombination.

The function of the DHS enzyme is well understood. The deoxyhypusine synthase reaction catalyzed by DHS involves interaction with three different substrates: spermidine, NAD, and eIF-5A precursor protein [eIF-5A(Lys)]. The first step of the reaction is the NAD-dependent dehydrogenation of spermidine, the second step involves trans-imination to form the DHS-imine intermediate, the third step involves trans-imination for the eIF-5A-imine intermediate, and the fourth step is the enzyme-coupled reduction of the eIF-5A-imine intermediate [Joe et al. (1997) J. Biol. Chem. 272:32679-685]. The enzyme-imine intermediate bond is formed between the 4-amino-butyl moiety of spermidine and the F-amino group of $Lys^{329}$ in the human enzyme [Joe et al. J. Biol. Chem. (1997) 272:32679-685]. Upon addition of the eIF-5A(Lys) precursor, the butylamine group is transferred to $Lys^{50}$ of human eIF-5A and then reduced to form deoxyhypusine. $Lys^{329}$ of human DHS is therefore crucial for DHS enzymatic activity, since it is absolutely required for the transfer of the butylamine group from spermidine to eIF-5A.

$Lys^{329}$ has been demonstrated to be a critical residue in the active site of human DHS (Table 1). Single point mutations of this conserved lysine (K329A or K329R) completely disrupt the ability of human DHS to catalyze the transfer of the butylamine group of spermidine to the conserved $Lys^{50}$ residue of eIF5A to generate deoxyhypusine [Joe et al. J. Biol. Chem. (1997) 272:32679-685; Wolff et al. (1997) J. Biol. Chem. 272:15865-71; Lee et al. Biochem J. (2001) 355:841-9]. The corresponding residue in yeast, $Lys^{35}$, has also been demonstrated to be critical for deoxyhypusine synthase activity [Wolff and Park (1999) Yeast 15:43-50]. The region surrounding and including $Lys^{329}$ in human DHS is highly conserved in plant species and a conserved region of seven amino acids in the active site from $Glu^{323}$ to $Lys^{329}$ (human DHS numbering) is absolutely conserved in examined plant DHS sequences (FIG. 1). This high degree of conservation suggests that mutation of the corresponding residue in plants will result in complete abolition of the ability of the expressed enzyme to catalyze the synthesis of deoxyhypusine.

TABLE 1

Active regions of Human DHS.

| DHS Function | Residues | Reference |
|---|---|---|
| Intermediate formation with the butylamine moiety of spermidine | $Lys^{329}$ | Wolff et al. (1997) J. Biol. Chem. 272: 15865-71 |
| NAD binding | $Asn^{106}$, $Asp^{238}$, $His^{288}$, $Asp^{313}$, $Asp^{342}$ | Lee et al. (2001) Biochem. J. 355: 841-9 |
| Spermidine binding and reaction | $His^{288}$, $Trp^{327}$, $Lys^{329}$, $Asp^{316}$, $Glu^{323}$ | Lee et al. (2001) Biochem. J. 355: 841-9 Wolff et al. (1997) J. Biol. Chem. 272: 15865-71 Wolff et al. (2000) J. Biol. Chem. 275: 9170-7 |

Amino acid residues that have been identified as being involved in $NAD^+$ binding in human DHS, $Asn^{106}$, $Asp^{238}$, $His^{288}$, and $Asp^{313}$, are conserved in all examined plant DHS sequences (FIG. 1 and Table 1). Residues which participate in spermidine binding and catalysis of deoxyhypusine synthesis in human DHS, $His^{288}$, $Trp^{327}$, $Lys^{329}$, $Asp^{316}$, and $Glu^{323}$, are also conserved in plant DHS sequences [FIG. 1 and Table 1; Lee et al. (2001) Biochem J. 355:841-9]. The critical residue $Lys^{287}$, which is important for covalent intermediate formation [Joe et al. (1997) J. Biol. Chem. 272:32679-685] and $Lys^{329}$, which is the catalytic center and critical for the enzymatic activity of DHS and formation of intermediate with the transfer of the butylamine moiety of spermidine are also highly conserved (FIG. 1 and Table 1).

Although the sequences are highly conserved in the active regions of DHS, the numbering of important residues differs in plant species compared to human. The numbering of important residues in M. sativa and the corresponding residue No. of the human DHS is shown in Table 2. For example, $Lys^{287}$ and $Lys^{329}$ of human DHS correspond to $Lys^{292}$ and $Lys^{334}$ of M. sativa, respectively.

TABLE 2

Amino acid residues in human DHS demonstrated to be critical to DHS functional activity and the corresponding residues in alfalfa (M sativa).

| Human DHS Residue | M sativa DHS Residue |
|---|---|
| K329 | K334 |
| K287 | K292 |
| K338 | K343 |
| W327 | W332 |
| K141 | K144 |
| D313 | D318 |

Other residues involved in the binding of $NAD^+$ and/or spermidine have also been identified as being critical for human DHS enzyme activity (Table 3). These include $Lys^{287}$, mutation of which leads to a 99% reduction (with respect to wild-type enzyme) in the ability of the enzyme to cleave spermidine and synthesize deoxyhypusine [Joe et al. (1997) J. Biol. Chem. 272:32679-685]. $Lys^{287}$, a highly conserved residue, participates in formation of a side pocket cavity that appears to be important for functional activity [Lee et al. (2001) Biochem J. 355:841-9; Umland et al. (2004) J. Biol. Chem. 279:28697-705]. This residue is adjacent to $His^{288}$, which is predicted to play a role in the NAD dehydrogenation of spermidine, perhaps by acting as a proton acceptor/donor [Umland et al. (2004) J. Biol. Chem. 279:28697-705]. Mutation of $His^{288}$ also resulted in a nearly complete loss of spermidine binding and enzymatic activity [Lee, 2001]. Other residues involved in spermidine binding also resulted in a drastic reduction in deoxyhypusine synthase activity when mutated to alanine. These include: D243A, W327A, H288A, D316A, E323A, K329A, and K329R (see Table 3; Lee et al. (2001) Biochem J. 355:841-9]. Along with $Lys^{327}$, residues $Asp^{316}$, $His^{288}$, and $Glu^{323}$, appear to help define a side pocket cavity [Umland et al. (2004) J. Biol. Chem. 279:28697-705]. Residues involved in $NAD^+$ binding were also found to result in an almost complete loss of enzymatic activity when mutated to alanine. These include: D342A, D313A, D238A, E137A (see Table 3; Lee et al. (2001) Biochem. J. 355:841-9].

Certain residues in human DHS have been identified, e.g., $K^{141}$, that when mutated result in a DHS protein which retains a certain measure of activity. For example, the K141R mutation in human DHS resulted in retention of 20% of the DHS activity (see Table 3; Joe et al. (1997) J. Biol. Chem. 272:32679-685]. Rather than creating a deletion, insertion, or substitution in DHS that completely abrogates deoxyhypusine synthase activity, it may be possible to introduce a specific single point mutation in a functionally important residue, such as $K^{141}$ ($K^{144}$ in M. sativa, Table 2) that would reduce the activity of the modified gene but not eliminate it. Screening independent progeny expressing a variety of residual activity levels, depending on whether 1, 2, 3 or 4 gene copies have been modified, could lead to identification of clones that demonstrate the maximum degree of improved resistance to stress and delayed senescence via incomplete hypusination of eIF-5A isoforms involved in stress and senescence pathways. In this case, it may be possible to find progeny that have all four DHS copies modified since there may be enough residual DHS activity present to prevent lethality.

alfalfa, and the polynucleotides that encode these proteins, including genomic sequences. The present invention also relates to methods involving genome editing or base editing (involving either deletions, insertions, or substitutions) to disrupt the activity of these DHS proteins by targeting amino acid residues critical for DHS deoxyhypusine synthase enzymatic activity.

TABLE 3

Previously described mutations, substitutions or deletions in the 369-aa Human DHS protein and their effects on DHS activities, including NAD+ binding, spermidine binding, eIF5A(Lys) binding, and deoxyhypusine synthase activity.

| DHS Mutation | Phenotype | Reference |
|---|---|---|
| N-terminal deletion of $Met_1$ to $Ala_{48}$ | Complete loss of activity | Joe et al. (1995) J. Biol. Chem. 270: 22386-392 |
| N-terminal deletion of deletion of $Met_1$ to $Cys_{97}$ | Complete loss of activity | Joe et al. (1995) J. Biol. Chem. 270: 22386-392 |
| Internal deletion of $Asp_{262}$ to $Ser_{317}$ | Complete loss of activity | Joe et al. (1995) J. Biol. Chem. 270: 22386-392 |
| Internal deletion of amino acids 269 to 317 | Complete loss of activity | Joe et al. (1995) J. Biol. Chem. 270: 22386-392 |
| C-terminal deletion of $Asp_{333}$ to $Asp_{369}$ | Complete loss of activity | Joe et al. (1995) J. Biol. Chem. 270: 22386-392 |
| K329A | Loss of intermediate formation with the butylamine residue of spermidine; Complete loss of deoxyhypusine synthesis; ~6% of spermidine cleavage activity | Wolff et al. (1997) J. Biol. Chem. 272: 15865-71 Joe et al. (1997) J. Biol. Chem. 272: 32679-685 |
| K329R | Complete loss of deoxyhypusine synthesis and spermidine cleavage | Joe et al. (1997) J. Biol. Chem. 272: 32679-685 |
| K287R or K287A | <1% of deoxyhypusine synthesis activity and spermidine cleavage | Joe et al. (1997) J. Biol. Chem. 272: 32679-685 |
| K338R | <10% of deoxyhypusine synthase activity; 35% spermidine cleavage activity | Joe et al. (1997) J. Biol. Chem. 272: 32679-685 |
| K141R | ~20% of deoxyhypusine synthesis activity; Small reduction in spermidine cleavage | Joe et al. (1997) J. Biol. Chem. 272: 32679-685 |
| W327A | ~2% spermidine cleavage activity; <<1% NADH forming activity | Wolff et al. (2000) J. Biol. Chem. 275: 9170-7 |
| D313A | Significantly reduced eIF5A(Lys) binding and NAD binding | Lee et al. (2001) Biochem. J. 355: 841-9 |
| D243A; W327A; H288A; D316A; E323A; K329A; or K329R | Almost complete loss of spermidine binding and enzyme activity | Lee et al. (2001) Biochem. J. 355: 841-9 |
| D342A; D313A; D238A; or E137 | Almost complete loss of NAD binding and enzyme activity | Lee et al. (2001) Biochem. J. 355: 841-9 |

The ability to construct homozygous mutations that reduce but don't eliminate catalytic function of the DHS protein is particularly important in crops grown from hybrid seeds. Examples include corn, wheat, soybeans, grain *Sorghum*, cotton, peanuts and many other crops. In these cases, elite inbred strains are used as parents that are homozygous at most loci. One or both parental lines having reduced activity due to targeted mutations in their DHS genes would be particularly advantageous in the resulting hybrid seeds sold to farmers.

Presently, there is no widely applicable method for controlling the onset of programmed cell death (including senescence) caused by either internal or external, e.g., environmental stress, factors. It is, therefore, of interest to develop senescence modulating technologies that are applicable to all types of plants and that are effective at the earliest stages in the cascade of events leading to senescence. Genome editing of DHS is a possible solution to reduce loss in plant yields due to environmental stress, as well as increase shelf life of perishable produce such as fruits, vegetables and flowers.

SUMMARY OF THE INVENTION

The present invention provides protein sequences of deoxyhypusine synthase from plant species, including The present invention provides a method for genetic modification of plants to control the onset of senescence, either age-related senescence or environmental stress-induced senescence. One of several genome editing technologies, including but not limited to RTDS, TALEN, CRISPR-Cas9, CRISPR-Cms1, ARCUS or base editing, is used to introduce a deletion, insertion, or substitution in the region of an amino acid residue critical for DHS function, in order to lead to the reduction or elimination of the DHS protein activity, thereby reducing the level of functionally active endogenous senescence-induced DHS protein, and reducing and/or preventing activation of eIF-5A and ensuing downstream expression of the genes that mediate senescence.

Methods and compositions are provided herein for the control of DHS protein activity involving sequence targeting, such as genome perturbation or gene-editing, that relate to the CRISPR-Cms1 system and components thereof as set forth in U.S. Pat. No. 9,896,696; Begemann et al. (2017) Scientific Reports 7, Article 11606; and Begemann et al. (2017) bioRxiv (DOI). Cms1 was previously referred to as Csm1 (see U.S. Pat. No. 9,896,696).

The disclosures of which are incorporated herein by reference. In certain embodiments, the Type V CRISPR enzyme is a Cms enzyme, e.g., a Cms1 ortholog, particularly MiCms1. The methods and compositions include nucleic acids to bind target DNA sequences. This is advantageous as nucleic acids are much easier and less expensive to produce than, for example, peptides, and the specificity can be varied according to the length of the stretch where homology is sought. Complex 3-D positioning of multiple fingers, for example is not required. The Cms1 enzyme is also smaller than Cas9, works more efficiently in plants, and leaves sticky ends instead of blunt ends after DNA cutting.

An alternative to genome editing for making useful changes to the DHS genomic sequence is CRISR base editing, particularly to make point mutations in the coding region of DHS genes at the active site or any of its $NAD^+$ binding sites. This recent technology uses catalytically inactivated CRISPR nucleases, such as dead Cas9 (dCas9), fused to diverse functional domains for targeting genetic modifications to specific DNA sequences [Eid et al. Biochem J. (2018) 475: 1955-1964]. No double-strand breaks are generated, and the dCas9 targets adeninine or cytidine deaminases to convert their target nucleotides into other DNA bases. Many examples of specific targets of base editing the Lys149 codon (one of the $NAD^+$ binding sites) in 29 plant species are provided in Example 13.

Using the methods of the invention, genome edited or base edited plants are generated and monitored for growth, development and either natural or delayed senescence. Plants or detached parts of plants (e.g., cuttings, flowers, vegetables, fruits, seeds or leaves) exhibiting prolonged life or shelf life, (e.g., extended life of flowers, reduced fruit or vegetable spoilage), enhanced biomass, increased seed yield, increased resistance to physiological disease (e.g., blossom end rot, reduced seed aging and/or reduced yellowing of leaves) due to reduction in the level of senescence-induced DHS, senescence-induced eIF-5A or both are selected as desired products having improved properties including reduced leaf yellowing, reduced petal abscission, reduced fruit and vegetable spoilage during shipping and storage. These superior plants are propagated. Similarly, plants exhibiting increased resistance to environmental stress (e.g., high or low temperatures, drought, low nutrient levels, high salt, crowding, pathogen infection, and/or physiological disease) are selected as superior products.

The type of plant which can be used in the methods of the invention is not limited and includes, for example, ethylene-sensitive and ethylene-insensitive plants; fruit bearing plants such as apricots, apples, oranges, bananas, grapefruit, pears, tomatoes, strawberries, avocados, grapes, etc. In some embodiments, the plant is a vegetable such as carrots, peas, lettuce, cabbage, turnips, potatoes, broccoli, asparagus, etc. In some embodiments, the plant is a flower such as carnations, roses, mums, etc. In some embodiments, the plant is an agronomic crop plant and includes forest species such as corn, rice, soybean, alfalfa, wheat, cotton, sugarbeet, canola, *Sorghum*, sunflower, *Camelina*, peanuts, trees and the like. In general, any plant that can take up DNA molecules for genome editing can be used in the methods of the invention and may include plants of a variety of ploidy levels, including haploid, diploid, tetraploid and polyploid. The plant may be either a monocotyledon or dicotyledon.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

FIG. 1. Alignment of various plant DHS proteins with the human DHS protein. Lane 1: *Homo sapiens* DHS (Accession No. NP 001921) (SEQ ID NO: 10); Lane 2: *Arabidopsis thaliana* (Accession No. NP 196211) (SEQ ID NO: 11); Lane 3: *Camelina sativa* DHS (accession number XP 010452500) (SEQ ID NO: 44); Lane 4: *Brassica rapa* DHS (accession number XP 009122196) (SEQ ID NO: 36); Lane 5: *Brassica napus* DHS (accession number XP_013715226) (SEQ ID NO: 38); Lane 6: *Gossypium hirsutum* DHS (accession number XP 016700362) (SEQ ID NO: 32); Lane 7: *Populus deltoides* DHS (sequence is not in GenBank; sequence is from FIGS. 109b in US Patent Application No. US 2010/0333233) (SEQ ID NO: 46); lane 8: *Camellia sinensis* DHS (plantkingdomgdb.com/teatree/data/pep/Teatree_Protein.fas; Xia (2017) Molecular Plant 10:866-877) (SEQ ID NO: 54); lane 9: *Vitis vinifera* DHS (SEQ ID NO: 52); Lane 10: *Medicago sativa* DHS (sequence is not in GenBank; sequence is from FIGS. 107a and 107b in U.S. Pat. No. 8,563,285) (SEQ ID NO: 2); Lane 11: *Cicer arietinum* DHS (accession number XP 004504559.1) (SEQ ID NO: 50); Lane 12: *Arachis duranensis* DHS (accession number XP 015966414) (SEQ ID NO: 18); Lane 13: *Arachis ipaensis* DHS (accession number XP_016203820) (SEQ ID NO: 20); Lane 14: *Glycine max* DHS 1 (accession number NP 001235604) (SEQ ID NO: 22); Lane 15: *Glycine max* DHS 2 (accession number NP 001237752) (SEQ ID NO: 24); Lane 16: *Phaseolus vulgaris* DHS (accession number XP 007152935) (SEQ ID NO: 48); Lane 17: *Beta vulgaris* subsp. *vulgaris* (accession number XP 010681287) (SEQ ID NO: 34); Lane 18: *Solanum lycopersicum* DHS (accession number NP 001234495) (SEQ ID NO: 12); Lane 19: *Solanum tuberosum* DHS (accession number XP 006348136) (SEQ ID NO: 42); lane 20: *Coffea canephora* DHS (SEQ ID NO: 56); Lane 21: *Triticum aestivum* DHS (accession number ACP28133) (SEQ ID NO: 13); Lane 22: *Oryza sativa Japonica* Group DHS (accession number XP 015628158) (SEQ ID NO: 30); Lane 23: *Zea mays* DHS 1 (accession number NP 001149084) (SEQ ID NO: 26); Lane 24: *Sorghum bicolor* DHS (accession number XP 002466487) (SEQ ID NO: 40); Lane 25: *Zea mays* DHS 2 (accession number NP 001130806) (SEQ ID NO: 28); Lane 26: *Musa acuminate* DHS (accession number XP 009404132) (SEQ ID NO: 14); lane 27: *Theobroma cacao* DHS (cacaogenomedb.org CGD0006914) (SEQ ID NO: 53); lane 28: Partial amino acid sequence of *Mentha longifolia* DHS (Mint Genomics Resource; langelabtools.wsu.edu/mgr/; TRINITY DN66685 cl g8 il)(SEQ ID NO: 55); lane 29: *Lactuca sativa* DHS (accession number AAU34016) (SEQ ID NO: 64). Consensus sequence (SEQ ID NO: 51) is shown in the last lane (! is either of L, Q, I or V, $ is either of L or M, % is either of R, F or Y, # is any of H, T, K, N, A, D, Q or E). A conserved region of seven amino acids in the active site from E323 to K329 (human DHS numbering) is bolded black and enclosed with a box. $NAD^+$ binding regions are bolded in purple. The catalytic lysine residue (K329 of human DHS) is bolded black and underlined. Other important residues are highlighted (human DHS numbering): blue (K287), green (K338), yellow (K141), red (W327), purple (D313).

FIG. 4. Nucleotide sequence of the DHS gene of *B. napus* [SEQ ID NO: 37]. Start and stop codons at 84 and 1188, respectively, are italicized and underlined. Regions targeted by the three CRISPR guide RNAs are in bold and underlined starting at 600, 635, and 1157. The guanine (G) nucleotide deleted in the DHS gene of *B. napus* line #16 at 569 and the resulting TGA stop codon at 652 are highlighted and underlined.

FIG. 6. Alignment of DNA sequences from GE0568-DHS1 rice calluses displaying the locations of internal deletions. Bold text represents the inverse complement of the MiCms1 PAM site (TTTC).

FIG. 7. Alignment of DNA sequences from GE0568-DHS1 T0 rice plants displaying the locations of internal deletions and inserts. Bold text represents the inverse complement of the MiCms1 PAM site (TTTC).

DETAILED DESCRIPTION OF THE INVENTION

Figure 2:
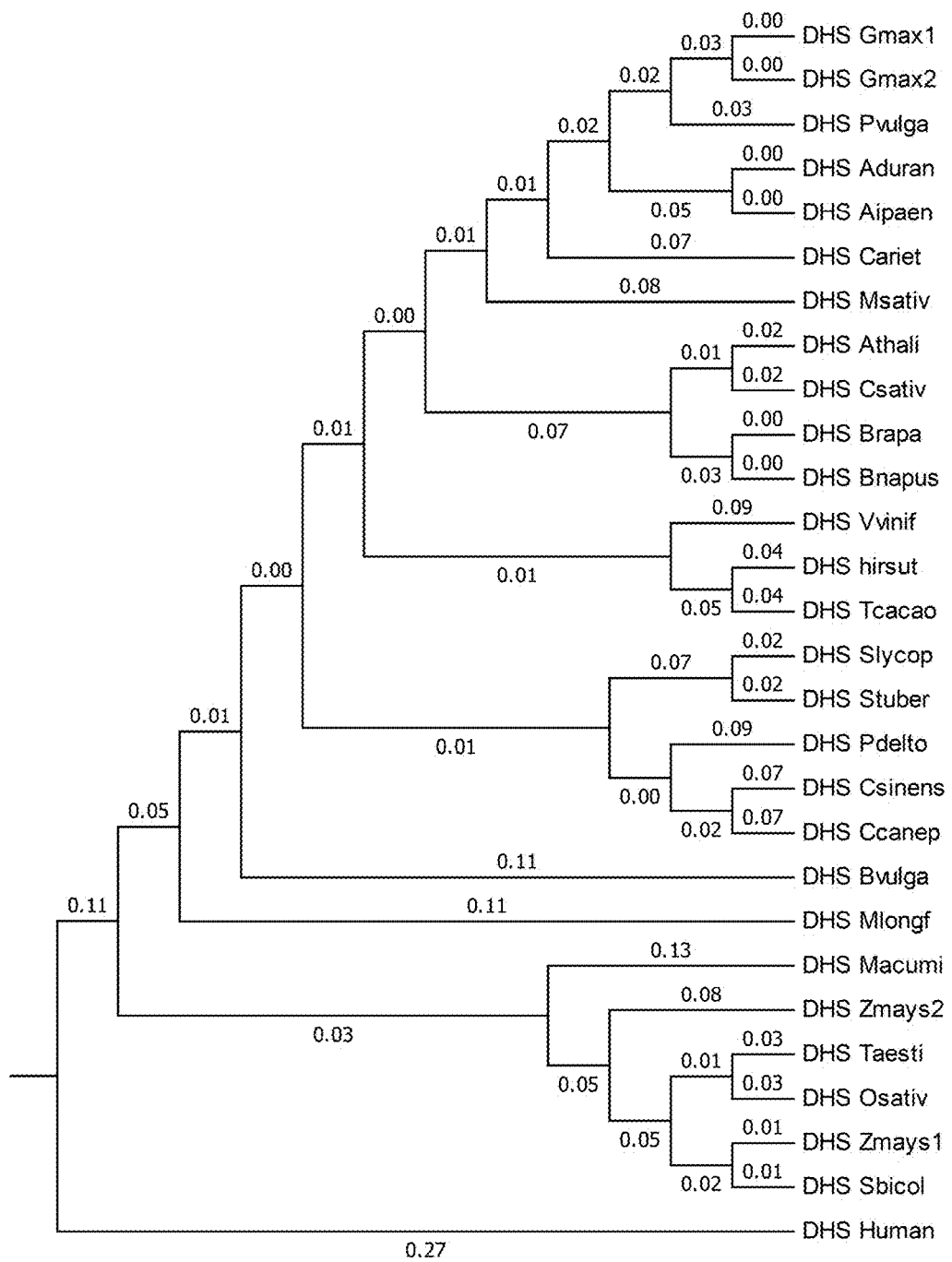
FIG. 2. Phylogenetic analyses of DHS proteins from different organisms revealing that DHS proteins are closely related. The dendrogram shows the evolutionary relationship between twenty-eight different DHS proteins from twenty-six different organisms. The phylogenetic tree clustering was conducted on all the proteins listed in FIG. 1 using BioEdit 7.2 software [bioedit.software.informer.com/7.2/] with ClustalW sequence alignment and the Unweighted Pair Group Method with Arithmetic Mean (UPGMA) phylogenetic tree generating algorithm.

As used herein, a "corresponding residue" refers to any amino acid in a DHS protein, that upon alignment with a second DHS protein amino acid sequence (e.g., human DHS), which is in a different location based on numbering from the N-terminus to C-terminus, and would be in the same location but for the different numbering due to gaps introduced by any sequence alignment. Examples of corresponding residues are described herein and, for example, in FIG. 1. Examples of plant DHS amino acid sequences and corresponding nucleotide sequences include, but are not limited to, the sequence of the coding regions of *Medicago sativa* DHS (SEQ ID NO: 1) and its corresponding amino acid translation (SEQ ID NO: 2); cDNA sequence of *Arabidopsis thaliana* DHS (GenBank Accession No. NM_120674) (SEQ ID NO: 4); amino acid sequence of *Arabidopsis thaliana* DHS (GenBank Accession No. NP_196211) (SEQ ID NO: 11); cDNA sequence of *Solanum lycopersicum* DHS (GenBank Accession No. NM_001247566) (SEQ ID NO: 5); cDNA sequence of *Triticum aestivum* DHS (GenBank Accession No. FJ376389) (SEQ ID NO: 6); cDNA sequence of *Musa acuminate* DHS (GenBank Accession No. XM_009405857) (SEQ ID NO: 7); partial cDNA sequence of *Medicago truncatula* DHS (GenBank Accession No. XM_013591001) (SEQ ID NO: 8); cDNA sequence of *Medicago sativa* DHS (previously described in U.S. Pat. No. 8,563,285) (SEQ ID NO: 9); amino acid sequence of *Solanum lycopersicum* DHS (GenBank Accession No. NP_001234495) (SEQ ID NO: 12); amino acid sequence of *Triticum aestivum* DHS (GenBank Accession No. ACP28133) (SEQ ID NO: 13); amino acid sequence of *Musa acuminate* DHS (GenBank Accession No. XP_009404132) (SEQ ID NO: 14); partial amino acid sequence of *Medicago truncatula* DHS (GenBank Accession No. XP_013446455) (SEQ ID NO: 15); amino acid sequence of *Medicago sativa* DHS (previously described in U.S. Pat. No. 8,563,285) (SEQ ID NO: 2); cDNA sequence of *Arachis duranensis* DHS (GenBank Accession No. XM_016110928) (SEQ ID NO: 17); amino acid sequence of *Arachis duranensis* (GenBank Accession No. XP_015966414) (SEQ ID NO: 18); cDNA sequence of *Arachis ipaensis* DHS (GenBank Accession No. XM_016348334) (SEQ ID NO: 19); amino acid sequence of *Arachis ipaensis* (GenBank Accession No. XP_016203820) (SEQ ID NO: 20); cDNA sequence 1 of *Glycine max* DHS (LOC100305453) (GenBank Accession No. NM_001248675) (SEQ ID NO: 21); amino acid sequence 1 of *Glycine max* (GenBank Accession No. NP_001235604) (SEQ ID NO: 22); cDNA sequence 2 of *Glycine max* DHS (LOC100499650) (GenBank Accession No. NM 001250823) (SEQ ID NO: 23); amino acid sequence 2 of *Glycine max* (GenBank Accession No. NP_001237752) (SEQ ID NO: 24); cDNA sequence 1 of *Zea mays* DHS (GenBank Accession No. NM_001155612) (SEQ ID NO: 25); amino acid sequence 1 of *Zea mays* (GenBank Accession No. NP_001149084) (SEQ ID NO: 26); cDNA sequence 2 of *Zea mays* DHS (GenBank Accession No. NM_001137334) (SEQ ID NO: 27); amino acid sequence 2 of *Zea mays* (GenBank Accession No. NP_001130806) (SEQ ID NO: 28); cDNA sequence of *Oryza sativa Japonica* Group DHS (GenBank Accession No. XM_015772672) (SEQ ID NO: 29); amino acid sequence of *Oryza sativa Japonica* Group (GenBank Accession No. XP_015628158) (SEQ ID NO: 30); cDNA sequence of *Gossypium hirsutum* DHS (LOC107915737) (GenBank Accession No. XM_016844873) (SEQ ID NO: 31); amino acid sequence of *Gossypium hirsutum* (GenBank Accession No. XP_016700362) (SEQ ID NO: 32); cDNA sequence of *Beta vulgaris* subsp. *vulgaris* DHS (LOC104896269) (GenBank Accession No. XM 010682985) (SEQ ID NO: 33); amino acid sequence of *Beta vulgaris* subsp. *vulgaris* (GenBank Accession No. XP_010681287) (SEQ ID NO: 34); cDNA sequence of *Brassica rapa* DHS (LOC103846938) (GenBank Accession No. XM_009123948) (SEQ ID NO: 35); amino acid sequence of *Brassica rapa* (GenBank Accession No. XP_009122196) (SEQ ID NO: 36); cDNA sequence of *Brassica napus* DHS (LOC106419026) (GenBank Accession No. XM_013859772) (SEQ ID NO: 37); amino acid sequence of *Brassica napus* (GenBank Accession No. XP_013715226) (SEQ ID NO: 38); cDNA sequence of *Sorghum bicolor* DHS (GenBank Accession No. XM_002466442) (SEQ ID NO: 39); amino acid sequence of *Sorghum bicolor* (GenBank Accession No. XP 002466487) (SEQ ID NO: 40); cDNA sequence of *Solanum tuberosum* DHS (LOC102602600) (GenBank Accession No. XM_006348074) (SEQ ID NO: 41); amino acid sequence of *Solanum tuberosum* (GenBank Accession No. XP 006348136) (SEQ ID NO: 42); cDNA sequence of *Camelina sativa* DHS (LOC104734595) (GenBank Accession No. XM_010454198) (SEQ ID NO: 43); amino acid sequence of *Camelina sativa* (GenBank Accession No. XP_010452500) (SEQ ID NO: 44); cDNA sequence of *Populus deltoides* DHS (previously described in U.S. Publication No. 2010/0333233) (SEQ ID NO: 45); amino acid sequence of *Populus deltoides* (previously described in U.S. Publication No. 2010/0333233) (SEQ ID NO: 46); cDNA sequence of *Phaseolus vulgaris* DHS (GenBank Accession No. XM_007152873) (SEQ ID NO: 47); amino acid sequence of *Phaseolus vulgaris* (GenBank Accession No. XP_007152935) (SEQ ID NO: 48); cDNA sequence of *Cicer arietinum* DHS (LOC101505901) (GenBank Accession No. XM_004504502) (SEQ ID NO: 49); and amino acid sequence of *Cicer arietinum* (GenBank Accession No. XP_004504559) (SEQ ID NO: 50); a cDNA sequence of *Vitis vinifera* (grape) DHS (ENAICBI156001CB15600.3) (SEQ ID NO: 58); an amino acid sequence of *Vitis vinifera* (grape) DHS (SEQ ID NO: 52); a cDNA sequence of *Theobroma cacao* DHS (cacaogenomedb.org CGD0006914) (SEQ ID NO: 59); an amino acid sequence of *Theobroma cacao* DHS (cacaogenomedb.org CGD0006914) (SEQ ID NO: 53); a cDNA sequence of *Camellia sinensis* DHS (SEQ ID NO: 60); an amino acid sequence of *Camellia sinensis* DHS (plantkingdomgdb.com/tea_tree/data/pep/Teatree_Protein.fas; Xia et al. (2017) Molecular Plant 10:866-877) (SEQ ID NO: 54); a partial cDNA sequence of *Mentha longifolia* DHS (SEQ ID NO: 61); an amino acid sequence of *Mentha longifolia* DHS (Mint Genomics Resource; langelabtools.wsu.edu/mgd; TRINITY DN66685 cl g8 il) (SEQ ID NO: 55); a partial cDNA sequence of *Coffea canephora* DHS (SEQ ID NO: 62); an amino acid sequence of *Coffea canephora* DHS (SEQ ID NO: 56); cDNA sequence of algal *Guillardia theta* CCMP2712 DHS (NCBI Reference Sequence: XM_005831275.1) (SEQ ID NO: 63); an amino acid sequence of algal *Guillardia theta* CCMP2712 DHS (NCBI Reference Sequence: XP_005831332.1) (SEQ ID NO: 57); a cDNA sequence of *Lactuca sativa* (GenBank Accession No. AY731231) (SEQ ID NO: 65; sequence including flanking regions); and an amino acid sequence of *Lactuca sativa* (SEQ ID NO: 64).

For purposes of clarification, the cultivated peanut species (*Arachis hypogaea*) arose from a hybrid between two wild species of peanut: *A. duranensis* and *A. ipaensis* [Seijo et al. (2007) Am. J. Bot. 94 (12)1963-71; Kochert et al. (1996) Am. J. Bot. 83:1282-91; Moretzsohn et al. (2013) Ann. Bot. 111:113-126.] The amino acid sequences of the DHS protein between these parental diploids, *A. duranensis* and *A. ipaensis*, are identical (SEQ ID NOS: 18 and 20). Thus, the amino acid sequences of the DHS protein of the cultivated peanut (*Arachis hypogaea*) is expected to be identical to both parents.

By genome editing endogenous DHS genes to delete or modify specifically defined functionally critical residues, the resulting genome edited plants have no or substantially less DHS protein to activate eIF-5A. As discussed earlier, eIF-5A must be activated by DHS to render it biologically useful. Thus, by inhibiting or reducing the activity of DHS by genome editing, the resulting genome edited plants will have reduced active eIF-5A. These genome-edited plants will exhibit an increase in biomass of the plant, increased seed yield and/or increased seed size, and also be expected to be more tolerant to abiotic stresses and, in the case of plants producing perishable fruits or vegetables, extended post-harvest shelf life.

Further evidence to support the contention that DHS and eIF-5A play regulatory roles in senescence was provided by treating carnation flowers with inhibitors that are specific for DHS. Spermidine and eIF-5A are the substrates of DHS reaction [Park et al. (1993) Biofactors 4:95-104; Park et al. (1997) Biol. Signals. 6:115-123]. Several mono-, di-, and polyamines that have structural features similar to spermidine inhibit DHS activity in vitro [Jakus et al. (1993) J. Biol. Chem. 268:13151-13159]. Some polyamines, such as spermidine, putrescine, and spermine, have been generally used to extend carnation vase life [Wang and Baker (1980) Hort. Sci. 15:805-806]. Flower petal senescence was delayed 6 days after harvest of carnations that were vacuum infiltrated with a transient infection system expressing antisense DHS compared to untreated flowers [Hopkins et al. (2007) New Phytol. 175:201-214].

A further major loss in agriculture besides the loss of growth due to stress is post-harvest stress-induced senescence [McCabe et al. (2001) Plant Physiol. 127:505-516]. This is especially true for plants that are partially processed, such as cut lettuce. A symptom of cutting lettuce is browning which is a result of phenolics production [Matile et al. (1999) Annu. Rev. Plant Physiol. Mol. Biol. 50:67-95]. A field trial of lettuce with antisense polynucleotides of lettuce eIF-5A (LeIF-5A) or antisense full length DHS demonstrated that the transgenic lettuce was significantly more resistant to browning after cutting than the control lettuce. It appears that even though stress induced senescence due to harvesting has distinct circuitry [Page et al. (2001) Plant Physiol. 125:718-727], the translational control upstream of browning and likely other senescence symptoms is regulated at least in part by DHS and eIF-5A. Downstream of the regulation of senescence are the execution genes. These are the effectors of senescence and cause the metabolic changes that bring on the senescence syndrome. It appears that eIF-5A and DHS when down-regulated or reduced in activity are capable of dampening down a whole range of symptoms caused by senescence.

EXAMPLES

Example 1

Figure 3:
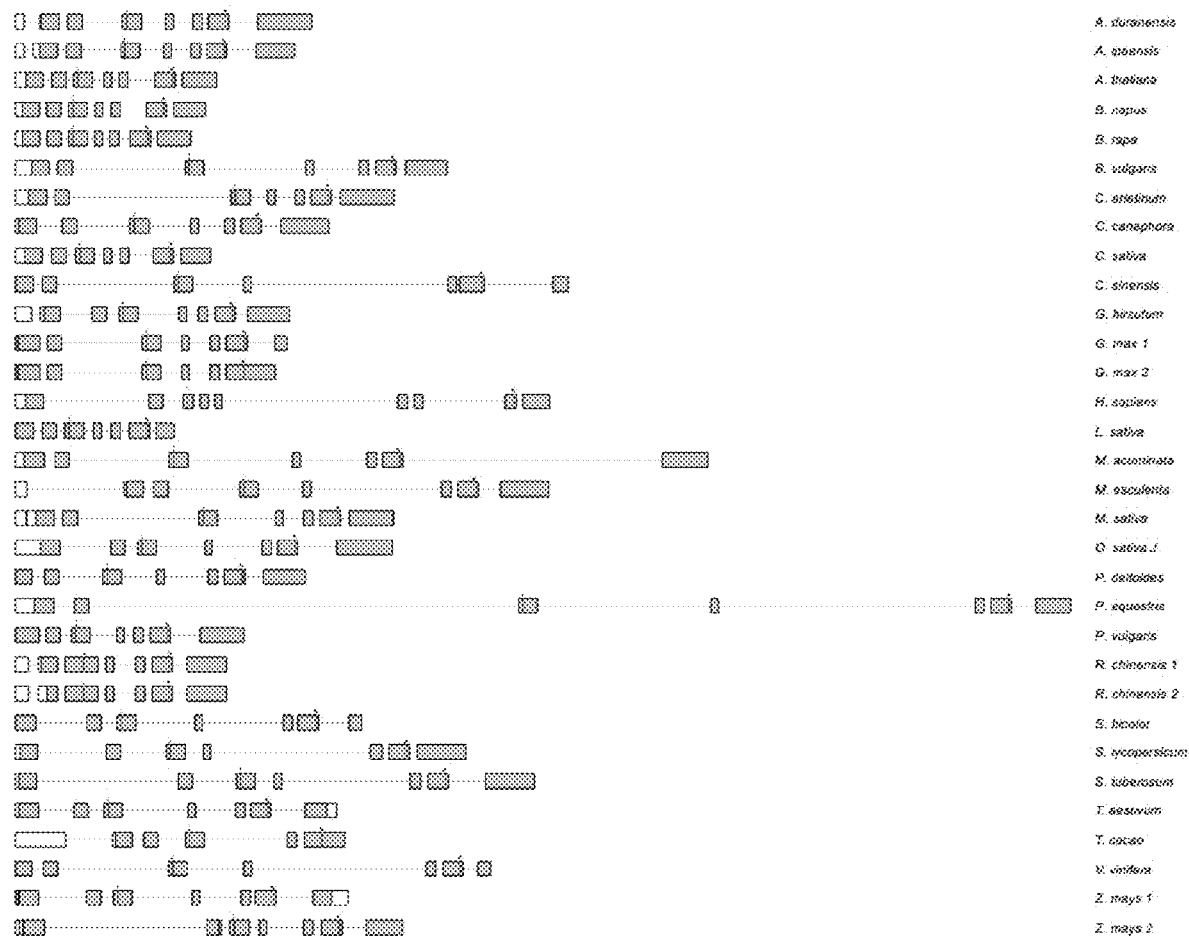
FIG. 3. Genomic DNA of DHS genes from various plant species. Boxes represent exons. Lines represent introns. The coding sequence is shaded. Red lines and down arrows (t) represent the lysine residue that forms a covalent intermediate with a butylamine moiety. Pink lines and asterisks (*) represent the active site.

Genomic DNA sequences were identified for 31 DHS genes from 28 plant species and human, and delineated into exons and introns. Two DHS genes are shown for *Glycine max* (soy), *Rosa chinensis* (rose), and *Zea mays* (maize). Other species (e.g., *Solanum lycopersicum*—tomato) may have more than one DHS gene, even if only one is provided. Guide RNAs for editing DHS genes can be targeted to exons or introns within the genomic DNA. The exon-intron boundaries of these genomic DNAs are illustrated in FIG. 3.

A genomic DNA sequence for a DHS gene of *Arachis duranensis* is SEQ ID NO: 66, and the corresponding exons and introns are SEQ ID NO: 67 to SEQ ID NO: 81. A genomic DNA sequence for a DHS gene of *Arachis ipaensis* is SEQ ID NO: 82, and the corresponding exons and introns are SEQ ID NO: 83 to SEQ ID NO: 97. A genomic DNA sequence for a DHS gene of *Arabidopsis thaliana* is SEQ ID NO: 98, and the corresponding exons and introns are SEQ ID NO: 99 to SEQ ID NO: 111. A genomic DNA sequence for a DHS gene of *Brassica napus* is SEQ ID NO: 112, and the corresponding exons and introns are SEQ ID NO: 113 to SEQ ID NO: 125. A genomic DNA sequence for a DHS gene of *Brassica rapa* is SEQ ID NO: 126, and the corresponding exons and introns are SEQ ID NO: 127 to SEQ ID NO: 139. A genomic DNA sequence for a DHS gene of *Beta vulgaris* subsp. Vulgaris is SEQ ID NO: 140, and the corresponding exons and introns are SEQ ID NO: 141 to SEQ ID NO: 153. A genomic DNA sequence for a DHS gene of *Cicer arietinum* is SEQ ID NO: 154, and the corresponding exons and introns are SEQ ID NO: 155 to SEQ ID NO: 167. A genomic DNA sequence for a DHS gene of *Coffea canephora* is SEQ ID NO: 168, and the corresponding exons and introns are SEQ ID NO: 169 to SEQ ID NO: 181. A genomic DNA sequence for a DHS gene of *Camelina sativa* is SEQ ID NO: 182, and the corresponding exons and introns are SEQ ID NO: 183 to SEQ ID NO: 195. A genomic DNA sequence for a DHS gene of *Camellia sinensis* is SEQ ID NO: 196, and the corresponding exons and introns are SEQ ID NO: 197 to SEQ ID NO: 209. A genomic DNA sequence for a DHS gene of *Gossypium hirsutum* is SEQ ID NO: 210, and the corresponding exons and introns are SEQ ID NO: 211 to SEQ ID NO: 225. A genomic DNA sequence for a DHS gene of *Glycine max* is SEQ ID NO: 226, and the corresponding exons and introns are SEQ ID NO: 227 to SEQ ID NO: 240. A second genomic DNA sequence for a DHS gene of *Glycine max* is SEQ ID NO: 241, and the corresponding exons and introns are SEQ ID NO: 242 to SEQ ID NO: 253. A genomic DNA sequence for a DHS gene of *Homo sapiens* is SEQ ID NO: 254, and the corresponding exons and introns are SEQ ID NO: 255 to SEQ ID NO: 271. A genomic DNA sequence for a DHS gene of *Lactuca sativa* is SEQ ID NO: 272, and the corresponding exons and introns are SEQ ID NO: 273 to SEQ ID NO: 285. A genomic DNA sequence for a DHS gene of *Musa acuminate* is SEQ ID NO: 286, and the corresponding exons and introns are SEQ ID NO: 287 to SEQ ID NO: 299. A genomic DNA sequence for a DHS gene of *Manihot esculenta* is SEQ ID NO: 300, and the corresponding exons and introns are SEQ ID NO: 301 to SEQ ID NO: 315. A genomic DNA sequence for a DHS gene of *Medicago sativa* is SEQ ID NO: 316, and the corresponding exons and introns are SEQ ID NO: 317 to SEQ ID NO: 331. A genomic DNA sequence for a DHS gene of *Oryza sativa Japonica* is SEQ ID NO: 332, and the corresponding exons and introns are SEQ ID NO: 333 to SEQ ID NO: 345. A genomic DNA sequence for a DHS gene of *Populus deltoides* is SEQ ID NO: 346, and the corresponding exons and introns are SEQ ID NO: 347 to SEQ ID NO: 359. A genomic DNA sequence for a DHS gene of *Phalaenopsis equestris* is SEQ ID NO: 360, and the corresponding exons and introns are SEQ ID NO: 361 to SEQ ID NO: 373. A genomic DNA sequence for a DHS gene of *Phaseolus vulgaris* is SEQ ID NO: 374, and the corresponding exons and introns are SEQ ID NO: 375 to SEQ ID NO: 387. A genomic DNA sequence for a DHS gene of *Rosa chinensis* is SEQ ID NO: 388, and the corresponding exons and introns are SEQ ID NO: 389 to SEQ ID NO: 401. A second genomic DNA sequence for a DHS gene of *Rosa chinensis* is SEQ ID NO: 402, and the corresponding exons and introns are SEQ ID NO: 403 to SEQ ID NO: 415. A genomic DNA sequence for a DHS gene of *Sorghum bicolor* is SEQ ID NO: 416, and the corresponding exons and introns are SEQ ID NO: 417 to SEQ ID NO: 429. A genomic DNA sequence for a DHS gene of *Solanum lycopersicum* is SEQ ID NO: 430, and the corresponding exons and introns are SEQ ID NO: 431 to SEQ ID NO: 443. A genomic DNA sequence for a DHS gene of *Solanum tuberosum* is SEQ ID NO: 444, and the corresponding exons and introns are SEQ ID NO: 445 to SEQ ID NO: 457. A genomic DNA sequence for a DHS gene of *Triticum aestivum* is SEQ ID NO: 458, and the corresponding exons and introns are SEQ ID NO: 459 to SEQ ID NO: 472. A genomic DNA sequence for a DHS gene of *Theobroma cacao* is SEQ ID NO: 473, and the corresponding exons and introns are SEQ ID NO: 474 to SEQ ID NO: 484. A genomic DNA sequence for a DHS gene of *Vitis vinfera* is SEQ ID NO: 485, and the corresponding exons and introns are SEQ ID NO: 486 to SEQ ID NO: 498. A genomic DNA sequence for a DHS gene of *Zea mays* is SEQ ID NO: 499, and the corresponding exons and introns are SEQ ID NO: 500 to SEQ ID NO: 514. A second genomic DNA sequence for a DHS gene of *Zea mays* is SEQ ID NO: 515, and the corresponding exons and introns are SEQ ID NO: 516 to SEQ ID NO: 531.

Example 2

An engineered homing endonuclease known as ARCUS is engineered to produce a nuclease that would be capable of creating a double-stranded cleavage in a region of *M. sativa* DHS that is required for its deoxyhypusine synthase activity. These regions targeted for cleavage could include the nucleic acids surrounding the regions that, when translated, include, for example either $Lys^{34}$ (corresponds to $Lys^{329}$ of human DHS—see Table 3) or $Lys^{292}$ ($Lys^{287}$ in human DHS). The DNA cleavage created by the engineered ARC nuclease would allow the creation of a small deletion, insertion or single-base pair substitution in a targeted region of plant DHS that is known to be critical for its deoxyhypusine synthase activity. In *M. sativa*, the activity of the enzyme can be disrupted by deleting one or more of the following residues: $Lys^{334}$ (corresponds to $Lys^{329}$ of human DHS—see Table 3) or $Lys^{292}$ ($Lys^{287}$ in human DHS). In one embodiment, the nucleotide region encoding the region surrounding, and including, $Lys^{334}$ of *M. sativa* DHS would be deleted in order to abolish deoxyhypusine synthase activity. In another embodiment, the nucleotide region encoding the region surrounding, and including, $Lys^{292}$ of *M. sativa* DHS would be deleted in order to abolish deoxyhypusine synthase activity.

Example 3

An engineered transcription activator-like effector (TALE) combined with a functional domain, for example, a FokI nuclease (TALEN), is engineered to produce a nuclease that would be capable of creating a double-stranded cleavage in a region of *M. sativa* DHS that is required for its deoxyhypusine synthase activity. These regions targeted for cleavage include the nucleic acids surrounding the region that, when translated, includes, for example either $Lys^{334}$ (corresponds to $Lys^{329}$ of human DHS—see Table 3) or $Lys^{292}$ ($Lys^{287}$ in human DHS). The DNA cleavage created by the engineered nuclease allows for a small deletion, insertion or single-base pair substitution in a targeted region of plant DHS that is known to be critical for its deoxyhypusine synthase activity. In *M. sativa*, the activity of the enzyme is disrupted by deleting one or more of the following residues: $Lys^{34}$ (corresponds to $Lys^{329}$ of human DHS—see Table 3) or $Lys^{292}$ ($Lys^{287}$ in human DHS). For example, the nucleotide region encoding the region surrounding, and including, Lys$^{334}$ of M. sativa DHS is deleted to abolish deoxyhypusine synthase activity. In another example, the nucleotide region encoding the region surrounding, and including, Lys$^{292}$ of M. sativa DHS is deleted to abolish deoxyhypusine synthase activity.

Example 4

A sgRNA is engineered to produce a guide RNA capable of creating a double-stranded cleavage in a region of M. sativa DHS that is required for its deoxyhypusine synthase activity, when introduced into the plant along with Cas9 (CRISPR-Cas9 system). These regions targeted for cleavage include the nucleic acids surrounding the region that, when translated, include, for example, either Lys$^{334}$ (corresponds to Lys$^{329}$ of human DHS—see Table 3) or Lys$^{292}$ (Lys$^{287}$ in human DHS). The DNA cleavage by cas9 allows for the creation of a small deletion, insertion or single-base pair substitution in a targeted region of plant DHS that is known to be critical for its deoxyhypusine synthase activity. In M. sativa, the activity of the enzyme is disrupted by deleting one or more of the following residues: Lys$^{334}$ (corresponds to Lys$^{329}$ of human DHS—see Table 3) or Lys$^{292}$ (Lys$^{287}$ in human DHS). For example, the nucleotide region encoding the region surrounding, and including, Lys$^{334}$ of M. sativa DHS is deleted in order to abolish deoxyhypusine synthase activity. In another example, the nucleotide region encoding the region surrounding, and including, Lys$^{292}$ of M. sativa DHS is deleted in order to abolish deoxyhypusine synthase activity.

Example 5

A GRON is engineered to produce an oligonucleotide that creates a mismatch error and subsequent repair using the GRON as a template (RTDS™), so as to create a desired substitution or deletion in a region of M. sativa DHS that is required for its deoxyhypusine synthase activity. These regions targeted for cleavage include the nucleic acids surrounding the region that, when translated, includes, for example either Lys$^{334}$ (corresponds to Lys$^{329}$ of human DHS—see Table 3) or Lys$^{292}$ (Lys$^{287}$ in human DHS). The mismatch created by the GRON produces a small deletion, insertion or single-base pair substitution in a targeted region of plant DHS that is known to be critical for its deoxyhypusine synthase activity. In M. sativa, the activity of the enzyme is disrupted by deleting one or more of the following residues: Lys$^{34}$ (corresponds to Lys$^{329}$ of human DHS—see Table 3) or Lys$^{292}$ (Lys$^{287}$ in human DHS). For example, the nucleotide region encoding the region surrounding, and including, Lys$^{34}$ of M. sativa DHS is deleted in order to abolish deoxyhypusine synthase activity. In another example, the nucleotide region encoding the region surrounding, and including, Lys$^{292}$ of M. sativa DHS is deleted in order to abolish deoxyhypusine synthase activity.

Example 6: Editing Pre-Determined Genomic Loci in Alfalfa (Medicago sativa)

One or more gRNAs is designed to anneal with a desired site in the alfalfa genome and to allow for interaction with one or more Cms1 or other CRISPR double stranded nuclease proteins. These gRNAs are cloned in a vector such that they are operably linked to a promoter that is operable in a plant cell (the gRNA cassette). One or more genes encoding a Cms1 or other CRISPR double stranded nuclease protein is cloned in a vector such that they are operably linked to a promoter that is operable in a plant cell (the CRISPR nuclease cassette). The gRNA cassette and the CRISPR nuclease cassette are each cloned into a vector that is suitable for plant transformation, and this vector is subsequently transformed into Agrobacterium cells. These cells are brought into contact with alfalfa tissue that is suitable for transformation. Following this incubation with the Agrobacterium cells, the alfalfa cells are cultured on a tissue culture medium that is suitable for regeneration of intact plants with selection against Agrobacterium cells. Alfalfa plants are regenerated from the cells that were brought into contact with Agrobacterium cells harboring the vector that contained the CRISPR nuclease cassette and gRNA cassette. Following regeneration of the alfalfa plants, plant tissue is harvested and DNA is extracted from the tissue. T7 endonuclease 1 (T7E1) assays and/or sequencing assays are performed, as appropriate, to determine whether a change in the DNA sequence has occurred at the desired genomic location.

Alternatively, particle bombardment is used to introduce the CRISPR nuclease cassette and gRNA cassette into alfalfa cells. Vectors containing a CRISPR nuclease cassette and a gRNA cassette are coated onto gold beads or titanium beads that are then used to bombard alfalfa tissue that is suitable for regeneration. Following bombardment, the alfalfa tissue is transferred to tissue culture medium for regeneration of alfalfa plants. Following regeneration of the alfalfa plants, plant tissue is harvested and DNA is extracted from the tissue. T7EI assays and/or sequencing assays are performed, as appropriate, to determine whether a change in the DNA sequence has occurred at the desired genomic location.

Example 7 Editing Pre-Determined Genomic Loci in Oryza sativa

One or more gRNAs is designed to anneal with a desired site in the Oryza sativa genome and to allow for interaction with one or more Cms1 or other CRISPR double stranded nuclease proteins. These gRNAs are cloned in a vector such that they are operably linked to a promoter that is operable in a plant cell (the gRNA cassette). One or more genes encoding a Cms1 or other CRISPR double stranded nuclease protein is cloned in a vector such that they are operably linked to a promoter that is operable in a plant cell (the CRISPR nucleasecassette). The gRNA cassette and the CRISPR nucleasecassette are each cloned into a vector that is suitable for plant transformation, and this vector is subsequently transformed into Agrobacterium cells. These cells are brought into contact with Oryza sativa tissue that is suitable for transformation with selection against Agrobacterium cells. Following this incubation with the Agrobacterium cells, the Oryza sativa cells are cultured on a tissue culture medium that is suitable for regeneration of intact plants. Oryza sativa plants are regenerated from the cells that were brought into contact with Agrobacterium cells harboring the vector that contained the CRISPR nuclease cassette and gRNA cassette. Following regeneration of the Oryza sativa plants, plant tissue is harvested and DNA is extracted from the tissue. T7EI assays and/or sequencing assays are performed, as appropriate, to determine whether a change in the DNA sequence has occurred at the desired genomic location.

Alternatively, particle bombardment is used to introduce the CRISPR nuclease cassette and gRNA cassette into Oryza sativa cells. Vectors containing a CRISPR nucleasecassette and a gRNA cassette are coated onto gold beads or titanium beads that are then used to bombard *Oryza sativa* tissue that is suitable for regeneration. Following bombardment, the *Oryza sativa* tissue is transferred to tissue culture medium for regeneration of intact plants. Following regeneration of the plants, plant tissue is harvested and DNA is extracted from this tissue. T7EI assays and/or sequencing assays are performed, as appropriate, to determine whether a change in the DNA sequence has occurred at the desired genomic location.

Example 8: Editing Pre-Determined Genomic Loci in *Brassica napus*

One or more gRNAs is designed to anneal with a desired site in the *Brassica napus* genome and to allow for interaction with one or more Cms1 or other CRISPR double stranded nuclease proteins. These gRNAs are cloned in a vector such that they are operably linked to a promoter that is operable in a plant cell (the gRNA cassette). One or more genes encoding a Cms1 or other CRISPR double stranded nuclease protein is cloned in a vector such that they are operably linked to a promoter that is operable in a plant cell (the CRISPR nucleasecassette). The gRNA cassette and the CRISPR nucleasecassette are each cloned into a vector that is suitable for plant transformation, and this vector is subsequently transformed into *Agrobacterium* cells. These cells are brought into contact with *Brassica napus* tissue that is suitable for transformation. Following this incubation with the *Agrobacterium* cells, the *Brassica napus* cells are cultured on a tissue culture medium that is suitable for regeneration of intact plants with selection against *Agrobacterium* cells. *Brassica napus* plants are regenerated from the cells that were brought into contact with *Agrobacterium* cells harboring the vector that contained the CRISPR nuclease cassette and gRNA cassette. Following regeneration of the *Brassica napus* plants, plant tissue is harvested and DNA is extracted from the tissue. T7EI assays and/or sequencing assays are performed, as appropriate, to determine whether a change in the DNA sequence has occurred at the desired genomic location.

Alternatively, particle bombardment is used to introduce the CRISPR nuclease cassette and gRNA cassette into *Brassica napus* cells. Vectors containing a CRISPR nuclease cassette and a gRNA cassette are coated onto gold beads or titanium beads that are then used to bombard *Brassica napus* tissue that is suitable for regeneration. Following bombardment, the *Brassica napus* tissue is transferred to tissue culture medium for regeneration of intact plants. Following regeneration of the plants, plant tissue is harvested and DNA is extracted from this tissue. T7EI assays and/or sequencing assays are performed, as appropriate, to determine whether a change in the DNA sequence has occurred at the desired genomic location.

Example 9: Deleting DNA from a Pre-Determined Genomic Locus Using Non Homologous End Joining A first gRNA is designed to anneal with a first desired site in the genome of a plant of interest and to allow for interaction with one or more Cms1 or other CRISPR double stranded nuclease proteins. A second gRNA is designed to anneal with a second desired site in the genome of a plant of interest and to allow for interaction with one or more CRISPR nuclease proteins. Each of these gRNAs is operably linked to a promoter that is operable in a plant cell and is subsequently cloned into a vector that is suitable for plant transformation. One or more genes encoding a Cms1 or other CRISPR double stranded nuclease protein is cloned in a vector such that they are operably linked to a promoter that is operable in a plant cell (the "CRISPR nuclease cassette"). The CRISPR nuclease cassette and the gRNA cassettes are cloned into a single plant transformation vector that is subsequently transformed into *Agrobacterium* cells. These cells are brought into contact with plant tissue that is suitable for transformation. Following this incubation with the *Agrobacterium* cells, the plant cells are cultured on a tissue culture medium that is suitable for regeneration of intact plants with selection against *Agrobacterium* cells. Alternatively, the vector containing the CRISPR nuclease cassette and the gRNA cassettes is coated onto gold or titanium beads suitable for bombardment of plant cells. The cells are bombarded and are then transferred to tissue culture medium that is suitable for the regeneration of intact plants. The gRNA-CRISPR nuclease complexes effect double-stranded breaks at the desired genomic loci and in some cases the DNA repair machinery causes the DNA to be repaired in such a way that some native DNA sequence that was located near or within the gRNA sequence is deleted. Plants are regenerated from the cells that are brought into contact with *Agrobacterium* cells harboring the vector that contains the CRISPR nuclease cassette and gRNA cassettes or are bombarded with beads coated with this vector. Following regeneration of the plants, plant tissue is harvested and DNA is extracted from the tissue. T7EI assays and/or sequencing assays are performed, as appropriate, to determine whether DNA has been deleted from the desired genomic location or locations.

Example 10: Making Base Substitutions in DNA at a Pre-Determined Genomic Locus Using Homology Directed Repair A gRNA is designed to anneal with a desired site in the genome of a plant of interest and to allow for interaction with one or more Cms1 or other CRISPR double stranded nuclease proteins. The gRNA is operably linked to a promoter that is operable in a plant cell and is subsequently cloned into a vector that is suitable for plant transformation. One or more genes encoding a Cms1 or other CRISPR double stranded nuclease protein is cloned in a vector such that they are operably linked to a promoter that is operable in a plant cell (the CRISPR nuclease cassette), along with a highly expressed single or double stranded donor DNA oligonucleotide comprised of a sequence homologous to a targeted DNA in the host genome but containing specific base changes that cause one or more targeted mutations that occur by Homology Directed Repair [Miki et al. (2018) Nature Comm. 9:1967-1975]. The CRISPR nuclease cassette, the gRNA cassette, and the highly expressed oligonucleotide are cloned into a single plant transformation vector that is subsequently transformed into *Agrobacterium* cells. These cells are brought into contact with plant tissue that is suitable for transformation. Said donor DNA oligonucleotide includes a DNA molecule that is to be inserted at the desired site in the plant genome, flanked by upstream and downstream flanking regions. The upstream flanking region is homologous to the region of genomic DNA upstream of the genomic locus targeted by the gRNA, and the downstream flanking region is homologous to the region of genomic DNA downstream of the genomic locus targeted by the gRNA. The upstream and downstream flanking regions mediate the recombination of DNA into the desired site of the plant genome. Following this incubation with the *Agro-* bacterium cells and introduction of the donor DNA, the plant cells are cultured on a tissue culture medium that is suitable for regeneration of intact plants with selection against *Agrobacterium* cells. Plants are regenerated from the cells that were brought into contact with *Agrobacterium* cells harboring the vector that contained the CRISPR nuclease cassette, gRNA cassettes and donor DNA oligonucleotide. Following regeneration of the plants, plant tissue is harvested and DNA is extracted from the tissue. T7EI assays and/or sequencing assays are performed, as appropriate, to determine whether the desired base changes have occurred at the desired genomic location or locations.

Example 11: DHS Editing in *Brassica napus* Using CRISPR-Cas9

*Brassica napus* (Canola) is an important oilseed crop and a dicot. The amphidiploid genome of *B. napus* has two copies of the DHS gene, one each from the contributing *B. rapa* (AA) and *B. oleracea* (CC) genomes. The LOC106419026 DHS gene (DHS1) of *B. napus* was edited using the CRISPR-Cas9 system to determine if senescence could be delayed. The methods for this example were adapted from previous gene editing studies in *B. napus*, which are herein incorporated in their entirety [Yang et al., Scientific Reports 7:7489, 2017].

Vector Construction:

The DNA sequences of the *B. napus* DHS gene that were selected for targeting by guide RNAs are identified FIG. 4. A plant delivery vector comprising the three guide RNA sequences was constructed in three steps according to the method of Lowder [Lowder et al., Plant Physiology 169:971-985, 2015].

Step 1) To reduce subcloning background, the AtU6-based cassette donor vector was digested first with Bgl II and Sal I restriction endonucleases, followed by a second digestion with Esp3l per the published protocol for assembly of a multiplex CRISPR-Cas9 T-DNA vector (plantphysiol.org/contnt/plantphysiol/suppl/2015/08/21/pp.15.00636.DC1/PP2015-00636R1_Supplemental_Materials_and_methods.pdf). Sense and antisense oligonucleotides with sequences corresponding to the three DHS guide RNAs were synthesized, annealed, and then individually inserted into donor vectors. The sequences of the resulting plasmids, pYPQ131A, pYPQ132A and pYPQ133A, were confirmed by Sanger sequencing.

Step 2) All three guide sequences were assembled into pYPQ143 using the Golden Gate© recombination system. Insertion of a Cas9 expression module into pYPQ143 yielded recombinant plasmid vector pYPQ150, which contained all CRISPR components required for targeted editing of the *B. napus* DHS gene.

Step 3) The CRISPR cassettes were incorporated into a plant delivery vector using the Gateway© recombination system to create a binary destination plasmid that contains a third module with PAT and kanamycin selection markers for recovering the transformants. The sequences of the CRISPR cassettes in the transformation vector were confirmed by Sanger sequencing. This derivative recombinant binary vector was introduced into *Agrobacterium* MP90 carrying a disarmed Ti plasmid with vir functions provided in trans.

Production of Transgenic Lines:

The recombinant T-DNA was delivered into receptive *B. napus* cells. Cotyledonary petioles were collected from 4-5 days old *B. napus* seedlings grown in jars under sterile conditions and expanded in tissue culture [Moloney et al., Plant Cell Reports 8:238-42, 1989; Babic et al., Plant Cell Reports 17:183-88, 1998]. The cotyledonary explants were placed on filter paper and co-cultivated with *Agrobacterium* carrying the CRISPR-based DHS targeting construct in medium containing 1 mg/l 2,4-Dichlorophenoxyacetic acid (2-4 D) for 2 days at 22° C. followed by 4 days at 4° C. The explants were then transferred to selection medium (MS) with 4 mg/6-benzyl aminopurine (BAP), 25 mg/l Kanamycin and 2.5 mg/l PPT. After 4-6 weeks, some of the explants produced green shoots from the petioles on the selection medium. To increase the number of putative transformed shoots, these steps were repeated 4 times using ~700 explants in each experiment. Green shoots recovered from these experiments were transferred to "elongation medium" containing 0.05 mg/l BAP and 0.02 mg/l Gibberellin A3 (GA3). Shoots that were not vitrified were transferred to rooting medium containing 50% MS plus 0.1 mg/l BAP, 25 mg/l kanamycin and 5 mg/l phosphinotricin (PPT). Shoots that successfully produced roots were transferred to pots to establish T0 plants, which were analysed by PCR for the presence of transgenes. A total of 55 *B. napus* transgenic lines were identified. The stringent double selection and confirmative molecular analysis ensured that these transgenic lines carry the recombinant DHS constructs. The DHS genes from 38 of these lines were amplified by PCR, subcloned into a plasmid, and then sequenced. All but one were identical to wild type. The exception, clone #16, had a 1 bp deletion adjacent to the sequence targeted by a guide RNA, resulting in a truncated DHS protein (FIG. 4). This truncated allele is missing the C-terminal active site of DHS and is expected to be completely inactive. Clone #16 also contained a wild-type DHS gene, indicating that it is a heterozygote.

Figure 5:
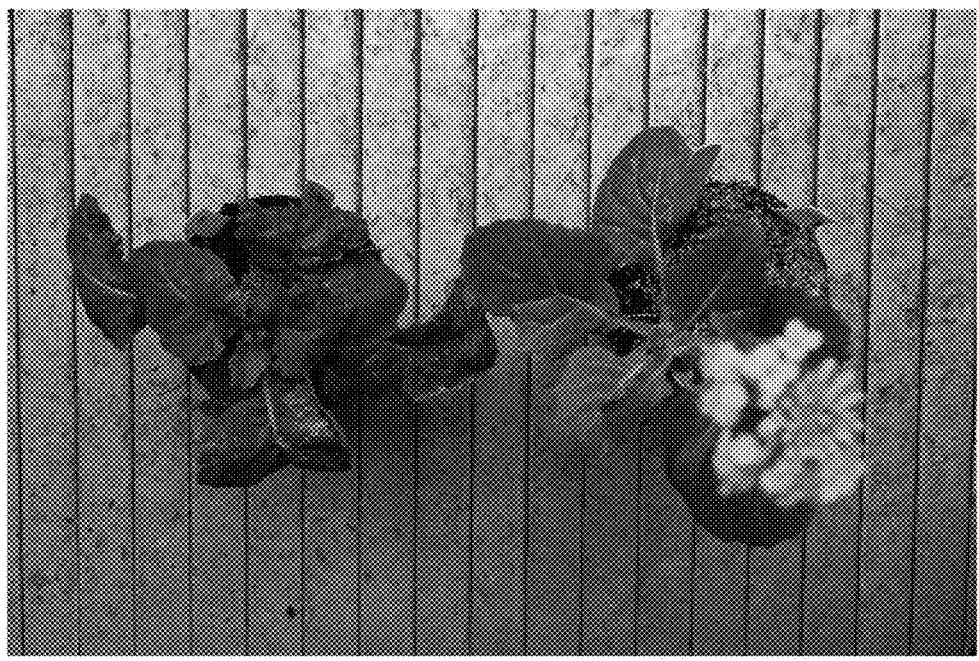
FIG. 5. *B. napus* line #16 plant (left) and a wild-type control *B. napus* plant (right). *B. napus* line 16 is a dwarf with darker green leaves, delayed flower emergence, and delayed senescence.

Phenotype Resulting from an Edited *B. napus* DHS Gene:

The transgenic DHS lines were grown in pots under controlled greenhouse conditions at 22° C. with a 16 h light/8 hrs dark cycle. Their development and growth was compared with non-transgenic control lines. The majority of the transgenic lines had DHS gene sequences identical to wild type and had normal growth and development patterns. In contrast, *B. napus* line #16, with an edited DHS gene, produced dwarf plants with darker leaves. Line #16 also displayed delayed leaf senescence and took 15-20 days longer to complete the growth and seed production cycle (FIG. 5).

Beneficial Effects of Editing the *B. napus* DHS Gene:

The compact dwarf phenotype, darker green leaves, and delayed senescence of *B. napus* plants with an edited DHS gene offer agronomic advantages. The compact dwarf phenotype offers less lodging and better shoot architecture for capturing sunlight. This could improve photosynthetic efficiency, thereby increasing oil production and seed yields in this important oil seed crop. The darker green leaves suggest a higher chlorophyll content and increased photosynthetic capacity. Delayed senescence results in "staying green longer," especially during critical and final phases of reproductive development, and is expected to enhance seed filling and production in *B. napus*, as observed in other diverse crop species.

Example 12: DHS1 Editing in *Japonica* Rice Using CRISPR-Cms1 with a Guide RNA Targeting the Intron Upstream of K149

*Oryza sativa* cv. Kitaake (*Japonica* rice) is a monocot. Edits were generated in the intron upstream of the NAD-binding site adjacent to K149 of the DHS1 gene of *O. sativa* cv. Kitaake. Most resulted in 3-21 bp deletions that do not affect the exon sequence, but may cause mis-splicing of the mRNA. Several larger (>50 nt) deletions and deletion with insertions were also observed. These would be predicted to affect the protein product, potentially resulting in a loss of function. T0 events generated with larger modifications were compared to T0 events generated at the same time with smaller modifications. The larger modifications were associated with a delay in flowering and an increase in chlorophyll content.

Guide RNA Design:

Kitaake rice has a highly-expressed DHS1 gene (OsKitaake 03g332300 (DHS1) on Chr3 at 31549616-31554176) and a homologous but rarely-expressed DHS2 gene (OsKitaake 09g102400 (DHS2) on Chr9 at 14897349-14900826). A guide RNA specific to the DHS1 gene and compatible with (CRISPR-Cms1 chemistry was designed to target the intron between the second and third exons. It had the following sequence,

[SEQ ID NO: 532]
AATTTCTACTGTTGTAGATAAGGGGGATTAGCTACATCATAGG, with underlining indicating a crRNA hairpin structure.

Figure 8:
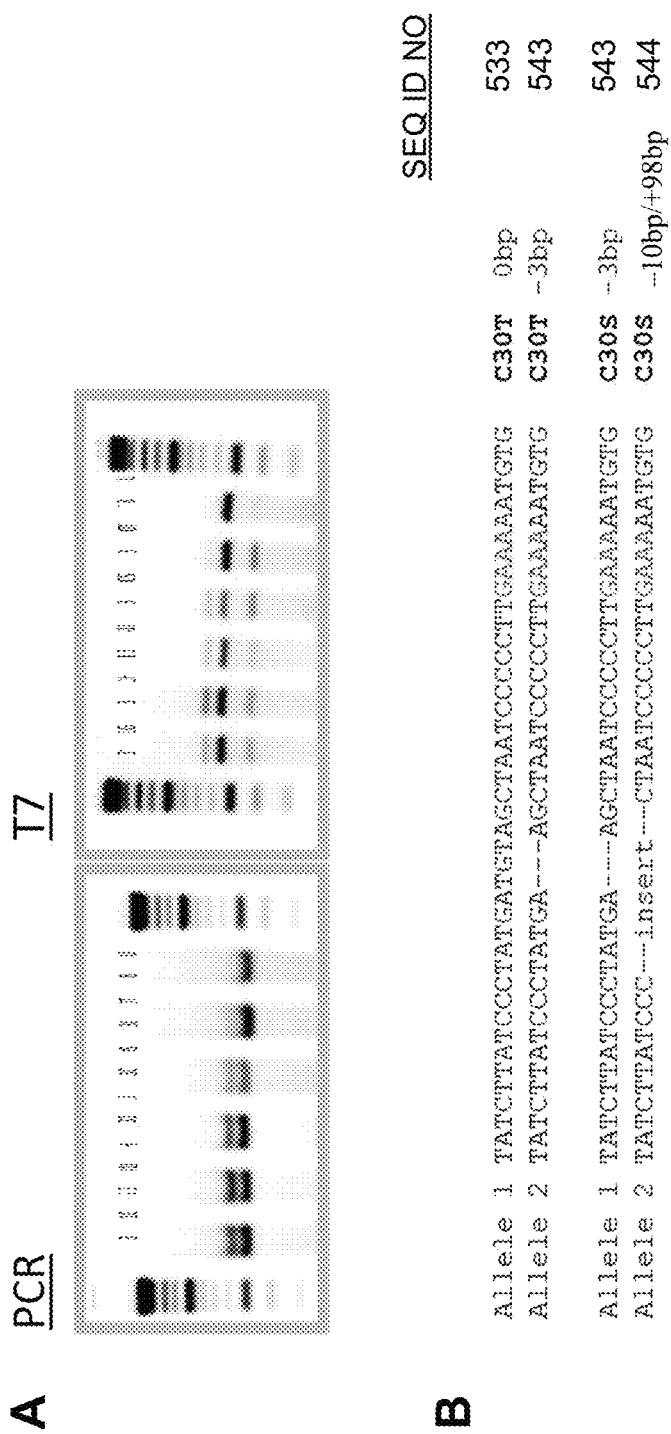
FIG. 8. Molecular analysis of T0 plants arising from callus 30. (A) PCR amplification of DHS1 from plant extracts (left). T7 nuclease treatment of the PCR products (right). The appearance of a lower band after treatment with T7 nuclease indicates heteroduplex formation and suggests the presence of an internal deletion. (B) Sequence alignments of the two DHS1 alleles isolated from T0 plants regenerated from callus 30T and callus 30S. Red text represents the inverse complement of the MiCms1 PAM site (TTTC).

Production of Gene Edited Rice Plants:

Callus derived from immature *O. sativa* cv. Kitaake seeds was bombarded with three plasmids separately containing a CRISPR nuclease, a guide RNA, and a marker providing resistance to hygromycin. After four weeks of selection, the callus material was screened for the presence of edits with a T7 Enoduclease I assay. Next Generation Sequencing of DNA from callus material with apparent edits revealed deletions at the target site ranging from 3 to 65 base pairs (FIG. 6). Plants were regenerated from callus pieces having internal deletions in DHS1. The T0 plants were screened with the T7 exonuclease assay and sequenced for verification (FIGS. 7 and 8). Lines C31G, C31H, and C31I have larger insertions. DNA from line C31H was sequenced and found to have the same insertion/deletion as event C30S, suggesting these two lines were derived from a common editing event.

Phenotype of T0 rice plants: T0 rice plants were regenerated, grown under greenhouse conditions, and compared with other T0 plants regenerated from the same callus material and transplanted to soil on the same date. Chlorophyll content was measured with a SPAD 502 Plus Chlorophyll Meter (specmeters.com/nutrient-management/chlorophyll-meters/chlorophyll/spad502p/#description). Lines C30S, C31G, C31H, and C31I all had a 10-day delay in flowering relative and a ≥11% increase in chlorophyll content compared to line C30T, indicating that large insertion/deletions cause delayed flowering and increased chlorophyll content (Table 4). No significant phenotypic differences were observed between lines derived from a separate callus piece (GE568-8) that had either small internal deletions in the intron or no detected edits (Table 5).

TABLE 4

Phenotypes of Kitaake Rice GE0568 T0 plants regenerated from callus 30 and 31.

| T0 plant ID | Edit | Days to Reproduction | Chlorophyll content (average SPAD reading) |
| --- | --- | --- | --- |
| GE0568 30T | 3 bp deletion | 21 | 32.9 |
| GE0568 30S | 10 bp deletion & 99 bp insertion | 31 | 36.6 |
| GE0568 31G | Insertion | 31 | 39.9 |

TABLE 4-continued

Phenotypes of Kitaake Rice GE0568 T0 plants regenerated from callus 30 and 31.

| T0 plant ID | Edit | Days to Reproduction | Chlorophyll content (average SPAD reading) |
| --- | --- | --- | --- |
| GE0568 31H | 10 bp deletion & 99 bp insertion | 31 | 38.1 |
| GE0568 31I | Insertion | 31 | 39.15 |

TABLE 5

Phenotypes of Kitaake Rice GE0568 T0 plants regenerated from callus 8.

| T0 plant ID | Edit | Days to Reproduction | Chlorophyll content (average SPAD reading) |
| --- | --- | --- | --- |
| GE0568 8W | Small indel | 28 | 36 |
| GE0568 8S | None | 31 | 42.8 |
| GE0568 8T | None | 28 | 42.8 |
| GE0568 8U | None | 28 | 42.8 |
| GE0568 8X | None | 31 | 34.85 |

To confirm the phenotypic differences observed with T0 rice plants, T1 plants are generated and genotyped by DNA sequencing. For each DNA editing event heterozygous plants are compared to null segregant and wild-type controls. In the unlikely event that homozygous mutant plants survive, they are also tested. For each genotype, twelve plants are grown in a greenhouse and phenotyped for biomass, flowering time, days to senescence, chlorophyll content and seed yield.

Figures 9, 10:
FIG. 9. Strategy for disrupting the active site of rice DHS1. (A) Genomic structure of the rice DHS1 gene with introns as thin crooked lines, and exons as filled black boxes. The active site (EAVSWGK SEQ ID NO: 546) is in Exon 6. (B) Sequence of WGK and 6 downstream codons, including the PAM site and gRNA sequence. The guide RNA is designed to target the sense strand (CDS) and is designed based on the antisense sequence.
FIG. 10. Sequence alignment of the two DHS1 alleles isolated from the heterozygous T0 line #2. The lower sequence has a 10 bp internal deletion resulting in the formation of a TGA stop codon (bold) that truncates the C-terminal 41 amino acids. The bold text in the antisense strand represents a PAM site.

Example 13: DHS1 Editing in *Japonica* Rice Using CRISPR-Cms1 with a Guide RNA Targeting the Active Site Lysine Guide RNA:

A guide RNA [SEQ ID NO: 581] was designed to introduce a mutation in the conserved active site (EAVSWGK; SEQ ID NO: 546) in exon 6 of the *Oryza sativa* cv. Kitaake DHS1 gene, as illustrated in FIG. 9. Sequence corresponding to the guide RNA was inserted behind a rice U6 small nuclear gene promoter in a plant delivery vector. The vector further comprises a Cms1 gene under a maize ubiquitin gene promoter, and a hygromycin-resistance marker.

Production of Gene Edited Rice Plants:

The plant delivery vector was transferred into *Agrobacterium* for transformation of Kitaake rice. Seven hygromycin-resistant T0 plants were regenerated and genotyped for mutations at the targeted site. One T0 plant (#2) was a monoallelic (or heterozygous) mutant with one wild-type allele and the other allele carrying a 10 bp deletion at the targeted active site. Other T0 plants were either wild type (homozygous normal) or too weak to survive for genotyping (homozygous mutant). Sequencing DNA extracted from plant #2 revealed a 10 bp deletion resulting in a frameshift that leads to a stop codon (FIG. 10; SEQ ID NO: 579). The resulting protein, missing 4 amino acids from the conserved active site and the subsequent 37 amino acids and is expected to be enzymatically inactive due to removal of 11% of the protein's total amino acids, yielding a protein of 334 amino acids instead of the wild-type 375 amino acids.

Figure 11:
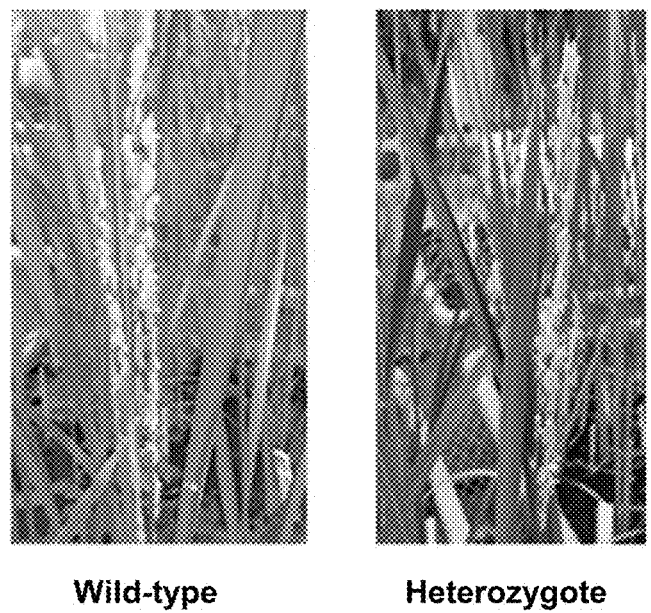
FIG. 11. Visual appearance of T1 plants with two wild-type DHS1 alleles (left) or one truncated DHS1 allele and one wild-type allele (right). The heterozygote has a darker green coloration.

Phenotype of Rice Plants Carrying C-Terminally Truncated DHS1:

The heterozygous T0 line #2 grew normally in the greenhouse with no apparent morphological differences other than a significant increase in seed size compared to homozygous wild type plants. The T1 progeny included four heterozygotes and six homozygous wild-types, but no homozygous DHS1 truncation mutants, suggesting that the homozygous truncation is lethal. T1 plants were grown to maturity in the greenhouse. Compared to wild-type controls, the heterozygous T1 plants are shorter, have a slightly higher tiller number, a similar spikelet number, and have seed that are about 25% larger (Table 6). Additionally, T1 plants carrying the C-terminally truncated DHS1 allele have a darker green appearance, suggesting higher chlorophyll content (FIG. 11).

The phenotypes observed in rice with a heterozygous C-terminally truncated DHS1 allele demonstrate the beneficial effects of reducing DHS activity through introducing specific mutations or deletions in genome edited crops, consistent with previous observations of reducing DHS expression using RNAi in *Arabidopsis thaliana*, tomato, and canola using antisense RNA [Duguay 2007; Wang 2001; Wang et al. (2003) Plant Mol. Biol. 52, 1223-1235; Wang et al. (2005) Physiol. Plant. 124, 493-503; Wang et al. (2005) Plant Physiol. 138, 1372-1382]. A 50% reduction in DHS activity using genome editing methods to make critical mutations seems to be in the "sweet spot" that these authors were able to obtain using very different transgenic antisense derivatives of wild-type DHS in several crops. DHS assembles into tetramers, so a reduction in activity might be caused by the formation of tetramers with a mix of full-length (active) and C-terminally truncated (inactive) subunits, segregation of full-length and C-terminally truncated DHS polypeptides into separate tetramers, or the premature degradation of C-terminally truncated polypeptides.

TABLE 6

Phenotypic comparison of T1 rice plants. Values are presented as mean ± standard deviation.

| Trait | Truncated DHS | Control |
|---|---|---|
| Height (cm) | 56.8 ± 16.6 | 69.4 ± 3.8 |
| Tiller number | 8.0 ± 2.6 | 6.0 ± 1.7 |
| Spikelet number | 36.7 ± 9.1 | 37.2 ± 5.5 |
| Seed mass (g/20 seeds) | 0.75 ± 0.03 | 0.59 ± 0.02 |

Example 14: General Strategy for Base Editing DHS in Various Plants

DHS activity is disrupted by genome or base editing the $NAD^+$-binding site adjacent to Lys149 and/or the active site near the C-terminus. Lys149 can be edited by replacing the second adenine in a Lys codon with a guanine to form an Arg codon, or by deletion. The 21 nucleotides encoding the active site can be altered by a specific mutation or deleted as part of a C-terminal truncation (Table 7).

TABLE 7

Site-Specific codon changes to $NAD^+$-binding sites near $Lys_{149}$ in genomic Exon 3/4 of DHS genes and 21-NT active site sequences.

| Species ID | Species name | Common name | $Lys_{149}$ Exon | $Lys_{149}$ codon | Arg codon | Active Site Exon | Sequence coding for the 7-amino acid Active Site | SEQ ID NO |
|---|---|---|---|---|---|---|---|---|
| Adur | *Arachis duranensis* | peanut parent 1 | 4 | AAG | AGG | 7 | GAAGCTGTTTCCTGGGGAAAA | 547 |
| Aipa | *Arachis ipaensis* | peanut parent 2 | 4 | AAG | AGG | 7 | GAAGCTGTTTCCTGGGGAAAA | 548 |
| Atha | *Arabidopsis thaliana* | Arabidopsis | 3 | AAA | AGA | 6 | GAAGCCGTGTCTTGGGGTAAA | 549 |
| Bnap | *Brassica napus* | canola | 3 | AAA | AGA | 6 | GAAGCAGTGTCTTGGGGTAAA | 550 |
| Brap | *Brassica rapa* | rape | 3 | AAA | AGA | 6 | GAGGCAGTGTCTTGGGGTAAA | 551 |
| Bvul | *Beta vulgaris subsp. vulgaris* | sugarbeet | 3 | AAA | AGA | 6 | GAGGCCGTGTCCTGGGGAAAG | 552 |
| Cari | *Cicer arietinum* | chickpea | 3 | AAG | AGG | 6 | GAGGCTGTTTCATGGGGAAA | 553 |
| Ccan | *Coffea canephora* | coffee | 3 | AAG | AGG | 6 | GAAGCTGTATCATGGGGAAAG | 554 |
| Csat | *Camelina sativa* | camelina | 3 | AAA | AGA | 6 | GAAGCCGTATCTTGGGGTAAA | 555 |
| Csin | *Camellia sinensis* | tea | 3 | AAA | AGA | 6 | GAAGCTGTATCATGGGGAAAA | 556 |
| Ghir | *Gossypium hirsutum* | cotton | 4 | AAA | AGA | 7 | GAAGCTGTTTCATGGGGAAA | 557 |
| Gmax1 | *Glycine max* | soybean | 4 | AAG | AGG | 7 | GAAGCTGTTTCATGGGGAAAG | 558 |
| Gmax2 | *Glycine max* | soybean | 4 | AAG | AGG | 7 | GAAGCTGTTTCATGGGGAAAG | 559 |
| Hsap | *Homo sapiens* | human | 3 | AAG | — | 8 | GAGGCTGTCTCCTGGGGCAAG | 560 |
| Lsat | *Lactuca sativa* | lettuce | 3 | AAA | AGA | 6 | GAAGCTGTCTCCTGGGGGAAA | 561 |
| Macu | *Musa acuminate* | banana | 3 | AAA | AGA | 6 | GAGGCGATTTCATGGGGAAAG | 562 |
| Mesc | *Manihot esculenta* | cassava | 4 | AAA | AGA | 7 | GAGGCTGTATCATGGGGAAAA | 563 |

TABLE 7-continued

Site-Specific codon changes to NAD⁺-binding sites near $Lys_{149}$ in genomic Exon 3/4 of DHS genes and 21-NT active site sequences.

| Species ID | Species name | Common name | $Lys_{149}$ Exon | $Lys_{149}$ codon | Arg codon | Active Site Exon | Sequence coding for the 7-amino acid Active Site | SEQ ID NO |
|---|---|---|---|---|---|---|---|---|
| Msat | Medicago sativa | alfalfa | 4 | AAG | AGG | 7 | GAGGCTGTTTCATGGGGAAA | 564 |
| Osat | Oryza sativa Japonica | rice | 3 | AAA | AGA | 6 | GAAGCAGTTTCATGGGGAAAG | 565 |
| Pdel | Populus deltoides | cottonwood | 3 | AAA | AGA | 6 | GAGGCTGTATCGTGGGGAAA | 566 |
| Pequ | Phalaenopsis equestris | orchid | 3 | AAG | AGG | 6 | GAGGCTGTTTCATGGGGAAAA | 567 |
| Pvul | Phaseolus vulgaris | common bean | 3 | AAG | AGG | 6 | GAGGCTGTTTCGTGGGGAAA | 568 |
| Rchi1 | Rosa chinensis | rose | 3 | AAA | AGA | 6 | GAGGCTGTCTCCTGGGGAAA | 569 |
| Rchi2 | Rosa chinensis | rose | 3 | AAA | AGA | 6 | GAGGCTGTCTCCTGGGGAAA | 570 |
| Sbic | Sorghum bicolor | sorghum | 3 | AAA | AGA | 6 | GAAGCAGTCTCATGGGCAAG | 571 |
| Slyc | Solanum lycopersicum | tomato | 3 | AAG | AGG | 6 | GAAGCTGTATCATGGGGAAAG | 572 |
| Stub | Solanum tuberosum | potato | 3 | AAG | AGG | 6 | GAAGCTGTATCATGGGGAAAG | 573 |
| Taes | Triticum aestivum | wheat | 3 | AAA | AGA | 6 | GAAGCAGTTTCATGGGGAAAG | 574 |
| Tcac | Theobroma cacao | cocoa | 4 | AAG | AGG | 6 | GAGGCTATTTCATGGGGAAA | 575 |
| Vvin | Vitis vinifera | grape | 3 | AAA | AGA | 6 | GAGGCTGTGTCATGGGGAAA | 576 |
| Zmay1 | Zea mays | corn | 3 (5) | AAA | AGA | 6(8) | GAAGCAGTCTCATGGGCAAG | 577 |
| Zmay2 | Zea mays | corn | 3 (6) | AAA | AGA | 6(9) | GAAGCGGTTTCATGGGGAAAG | 578 |

SEQUENCE LISTING (582 sequences)

SEQ ID NO: 1 - DNA, 1802 bp, Medicago sativa
  CDS (232)..(1338)
tataacaaacggtccgaccggatccaagttgcaccggttcgaaccgctttagttactactaacggttcgaaccgttatttttcaacccgtgacaaacgtggaaggcttcgttgtttcttcttcttcttcttaattaccatgcgtttttgtttttcttttgagtcattgaagtcttgttttttgtcgtgtttctgtcttgagaccgtgaaagagaaaacaaagagtacgagaatgagtgaaacaaagcaagaagatgatacaattatgtcctcagttcactccactgtcttcaaagaatccgaaaatctcgcaggaaagtgtgtccaaatcgagggttatgatttcaaccgcggcgtcgattatcaacagcttctcaaatcaatgctcacaactggttttcaagcttccaactttggtgatgccgttaaagtcgttaatcaaatgctagattggaggttggttgatgaaccaattgatgaggattgtgatgaagataagaaggatttggagtataggaaatctgttacatgcaaagtgtttttgggtttcacttctaatcttatctcttctggtgttagagatgttgttcgttacctttgtcagcatcacatggttcatgtagttgttacaactacaggtggtattgaagaagatcttataaagtgccttgcaccaacatataaaggagagttctctttgcccggagcttatcttcgctcaaaaggattgaatcgaatcggtaatttattggtccctaatgaaaattattgcaaatttgaggactggattattcctatttttgatcaaatgttgaaggagcaaaaggaagagaaagtgctgtggacaccgtctaagttaatagctcgattgggaaaagagatcaacaatgaaaactcctacctttactgggcatataagaacaatattccagtttattgtccaggattaaccgatggctcactgggtgacatgctgtacttccattccttccacaaccctggtctgattgtggacatagtgcaagatataagggccatgaatggtgaagctgtacatgcaaatcctagcaagacgggcatgattattttaggaggcggccttccaaaacatcacatttgcaatgccaatatgatgcgcaatggtgcagactatgcggtttttattaatactgcacaagaatttgatggaagtgattctggagctcgtccagatgaggctgtttcatgggggaaaatacgaggatctgctaaaactgttaaggtacattgtgatgcaacgatagcattccctctgctggttgctgaaacatttgcctcaagaacgtcaccccttaattgataaaggtccaccgtcaaaagtaaaaggtgtggctgggaagtgttttaccgcagctccacttgtgagtgccaaatgttttggtatgtaacttataagaccaaggtcggctgtatgtcatacttgagttgaggtcaaagttcatttgcaatgcagtgtgtttgaggatcttgatggaccagtttgccattgacttttaatttgactgtcttgttattcgcaaggtccacataacaagcatttttaccatttagaaacaatttattagtcctgaaggaattgagagtcatgaattcagatgtaaattatgcaatgctaactatatttttttggaactgtggtttctcttagatttgaggtgttgaaaaactgtaatatctagagcaaataagactagaaaagtttatcaactattactgatcagttatagtatcttcaatattttccagaaaaaaaaaaaaaaaaaa

SEQ ID NO: 2 - protein, 368 aa, Medicago sativa
MSETKQEDDTIMSSVHSTVFKESENLAGKCVQIEGYDFNRGVDYQQLLKSMLTTGFQASNFGDAVKVVNQMLDWRLVDEPIDEDCDEDKKDLEYRKSVTCKVFLGFTSNLISSGVRDVVRYLCQHHMVHVVVTTTGGIEEDLIKCLAPTYKGEFSLPGAYLRSKGLNRIGNLLVPNENYCKFEDWIIPIFDQMLKEQKEEKVLWTPSKLIARLGKEINNENSYLYWAYKNNIPVYCPGLTDGSLGDMLYFHSFHNPGLIVDIVQDIRAMNGEAVHANPSKTGMIILGGGLPKHHICNANMMRNGADYAVFINTAQEFDGSDSGARPDEAVSWGKIRGSAKTVKVHCDATIAFPLLVAETFASRTSPLN

SEQ ID NO: 3 - DNA, 1361 bp, Homo sapiens
aaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatgatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggacgtattggtgaccacagctggcggcgtggaggaagacctcatcaagtgcctggcgcccacatacttgggcgagtttagcctcagggggaaggagctccgggagaacgggatcaataggatcggaaacctgctggtgcccaatgagaattactgcaagtttgaggactggctgatgcccattctggaccagatggtgatggagcagaacacagagggtgtaaagtggacgccttctaagatgatcgcccggctgggcaaggagatcaacaacccagagtccgtgtattactgggcccagaagaaccacatccctgtgtttagtcccgcacttacagacggctcgctgggcgacatgatcttcttccattcctacaagaacccgggcctggtcctggacatcgttgaggacctgaggctcatcaacacacaggccatctttgccaagtgcactgggatgatcattctgggcgggggcgtggtcaagcaccacattgccaatgccaacctcatgcggaacggggccgactacgctgtttacatcaacacagcccaggagtttgatggctctgactcaggtgcccgaccagacgaggctgtctcctggggcaagatccgggtggatgcacagcccgtcaaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttccaaaaaaaaaa

SEQ ID NO: 4 - DNA, 1468 bp, Arabidopsis thaliana
atttgtcagcaaagattcgtttgaagatagttcatctttattccttcccctagaaccctagaactcccaaaaccctctactactacactttcagatccaaggaaatcaattttgtcattcgagcaacatggaggatgatcgtgttttctcttcggttcactcaacagttttcaaagaatccgaatcattggaaggaaagtgtgataaaatcgaaggatacgatttcaatcaaggagtagattacccaaagcttatgcgatccatgctcaccaccggatttcaagcctcgaatctcggcgaagctattgatgtcgtcaatcaaatgctagattggagactggctgatgaaactacagtagctgaagactgtagtgaagaggagaagaatccatcgtttagagagtctgtcaagtgtaaaatctttctaggtttcacttcaaatcttgtttcatctggtgttagagatactattcgttatcttgttcagcatcatatggttgatgttatagtcacgacaactggtggtgttgaggaagatctcataaaatgccttgcacctacatttaaaggtgatttctctctacctggagcttatttaaggtcaaagggattgaaccgaattgggaatttgctggttcctaatgataactactgcaagtttgaggattggatcattcccatctttgacgagatgttgaaggaacagaaagaagagaatgtgttgtggactccttctaaactgttagcacggctgggaaaagaaatcaacaatgagagttcatacctttattgggcatacaagatgaatattccagtattctgcccagggttaacagatggctctcttggggatatgctgtattttcactcttttcgtacctctggcctcatcatcgatgtagtacaagatatcagagctatgaacggcgaagctgtccatgcaaatcctaaaaagacagggatgataatccttggagggggcttgccaaagcaccacatatgtaatgccaatatgatgcgcaatggtgcagattacgctgtatttataaacaccgggcaagaatttgatgggagcgactcgggtgcacgccctgatgaagccgtgtcttggggtaaaattaggggttctgctaaaaccgttaaggtatactgtgatgctaccatagccttcccattgttggttgcagaaacatttgccacaaagagagaccaaacctgtgagtctaagacttaagaactgactggtcgttttggccatggattcttaaagatcgttgctttttgattttacactggagtgaccatataacactccacattgatgtggctgtgacgcgaattgtcttcttgcgaattgtactttagtttctctcaacctaaaatgatttgcagattgtgttttcgtttaaaacacaagagtcttgtagtcaataatcctttgccttataaaattattcagttccaacaa

SEQ ID NO: 5 - DNA, 1610 bp, Solanum lycopersicum
cgcagaaactcgcggcggcagtcttgttccgtacataatcttggtctgcaataatgggagaagctctgaagtacagtatcatggactcagtaagatcggtagttttcaaagaatccgaaaatctagaaggttcttgcactaaaatcgagggctacgacttcaataaaggcgttaactatgctgagctgatcaagtccatggtttccactggtttccaagcatctaatcttggtgacgccattgcaattgttaatcaaatgctagattggaggctttcacatgagctgcccacggaggattgcagtgaagaagaaagagatgttgcatacagagagtcggtaacctgcaaaatcttcttggggttcacttcaaaccttgtttcttctggtgttagagacactgtccgctaccttgttcagcaccggatggttgatgttgtggttactacagctggtggtattgaagaggatctcataaagtgcctcgcaccaacctacaagggggacttctctttacctggagcttctctacgatcgaaaggattgaaccgtattggtaacttattggttcctaatgacaactactgcaaatttgagaattggatcatcccagtttttgaccaaatgtatgaggagcagattaatgagaaggttctatggacaccatctaaagtcattgctcgtctgggtaaagaaattaatgatgaaacctcatacttgtattgggcttacaagaaccggattcctgtcttctgtcctggcttgacggatggatcacttggtgacatgctatacttccattctttcaaaaagggtgatccagataatccagatcttaatcctggtctagtcatagacattgtaggagatattagggccatgaatggtgaagctgtccatgctggtttgaggaagacaggaatgattatactgggtggagggctgcctaagcaccatgtttgcaatgccaatatgatgcgcaatggtgcagattttgccgtcttcattaacaccgcacaagagtttgatggtagtgactctggtgcccgtcctgatgaagctgtatcatggggaaagatacgtggtggtgccaagactgtgaaggtgcattgtgatgcaaccattgcatttcccatattagtagctgagacatttgcagctaagagtaaggaattctcccagataaggtgccaagtttgaacattgaggaagctgtccttccgaccacacatatgaattgctagcttttgaagccaacttgctagtgtgcagcaccatttattctgcaaaactgactagagagcagggtatattcctctaccccgagttagacgacatcctgtatggttcaaattaattatttttctccccttcacaccatgttatttagttctcttcctcttcgaaagtgaagagcttagatgttcataggttttgaattatgttggaggttggtgataactgactagtcctcttaccatatagataatgtatccttgtactatgagattttgggtgtgtttgataccaaggaaaaatgtttatttggaaaacaattggatttttaatttattttttcttgtttaaaaaaaaaaaaaaaaaaaaaaaaaa

SEQ ID NO: 6 - DNA, 1479 bp, Triticum aestivum
tgcggaggaggctcgtgctccgggtcagtggttcgccggagatggccggcgagggcggaagcggcggagagcgcagcaaggacccgctggagggcgtccgcgccatcgtgctgaagccgtccgagtccctcgacgagtcgcggttcaccaaaatcgccggcgccgacttcaacgacgccggcctcggcctcgacgggcttcttgggtcgctcgcctccacggggttccaggcgtccaacctcggcgacgccatcgacgtcgtcaatcagatgttagattggaggttgtcgcatgagaagccaaccgaggactgtgatgaagctgaacttgacccgaaatacagagaatctgtcaagtgcaagatattccttggtttcacttcgaaccttgtttcttccggtatacgggatgtaatccggtttctagttcaacatcacatggtggatgttgttgtgacgacagctgggggtatagaggaagacctcataaaatgcctagcaccaacgtaccgaggtgaattttctttacccggggcactgctacggtcaaaaggacttaaccggataggaaatctgttggtgcccaatgataactattgcaagtttgaaaactggatcatgccactctttgaccagatgctacaagagcaatctactgagaatgtctggacaccatcaaaggtgattgctcgtcttggcaaagaaataaatgatgaaagctcctacctttattgggcatacaagaacaatattcctgtatactgcccagcattgactgatggatcactcggagacatgctgttttgtcatgcagttcgcaatcctggtcttattatcgacattgtacaagatataaggctgataaatggtgaagccattcatgcaagcccaaggaagacaggggtcataattcttggtggaggccttccaaagcatcatatatgcaatgcaaatatgttccgcaatggtgcagattatgcagtctatatcaacacggctcaagagtttgatggaagtgactcaggagcacggccagatgaagcagtttcatggggaaagatcaaaggttcagcaaaacctgtaaaggtccactgtgatgcgactatcgctttcccgttacttgtagctgcaacatttgcacgtaggtctcatggtgcaaattcaaccaactgaatttctggcagcaaactaagggcctcaaattgatcttttattgatctccactcgtttgtctggactctttggaggataacatggaaggtttttgtcagatgccgaccacagttaccgattccttctgtttgatgtacacctgaggttgtaataccaattgtatcctttgtaatgagattatgtatggagtgccaacatattaggaaatattatgaaacggacgatcgttccactatttatatgactctggaaaactgtgactttataaagaaattatctggtaaaaaaaaaaaaaaaaaaaaaaaaa

SEQ ID NO: 7 - DNA, 1593 bp, Musa acuminata
gcgatcgcccttctcttctgcgccggcgcggcgcccgcaacgaatcttgcagagagtaagaaggatcctcgcctttgtcaccaaacccttggtttccagggaggcgacatggaaggcggcgccgcgggagggcagcgagaccgggaaaccctggacgcggtgcggtcggtggtgtttaagccctccgtatccttggaggagaagcggttcccgagggtccaggggtacgacttcaaccggggttgtgacctcatcggcctcctcgattccatgtccactaccgggttccaagcttccaacctcggcgacgccatcgatgtcatcaatcagatgattgactggaggctctcccatgatgcgcccacggaagattgcagcgaggaagagcgcaatctggcctacaggcaatcggtcacgtgcaagatctttctgggcttcacttcgaaccttgtatcttctggcatcagggagataattcggtttcttgtgcagcaccgaatggttgaagttttagtcacaactgctggcggcattgaagaagatttaatcaaatgccttgctcctacatataagggtgacttttctttgcctggatcgtatctgcgttcaaaaggattgaatcggataggaaaccttctggtccctaatgacaattactgcaaattcgaggactggatcatgccaattctggaccagatgttacttgaacagactacagagaatgtagtttggactccatcaaaagtgattgcgcgccttggaaaagaaataaatgatgaaagttcatacctgtactgggcatacaagaacaatgtttctgtctattgcccggcattgactgatggatcattgggggatatgttgtactgccattcagtgcggaatcctggtttacttattgatattgtgcaagacatacgagcaatgaatggagaagctatacatgtgggtctgagaaagactggggtcataattcttggtggggggctcccaaagcaccatatatgtaatgccaacatgtttcggaatggtgcagattatgctgtttatgtcaacactgcacaggaatttgatggaagtgattctggagcacagcctgatgaggcgatttcatggggaaagataaagggttctgcgaagactattaaagttcattgtgatgcaactattgcttttcctctattggtagctgcaacatttgcaagaaagtttcaggaaagaaacaacaaattagcctgatgggggtgcaaaaggtgatcatcttatttggattcaaataccctaatgtaatctgctaacatctgcagatgctgtattcttgcaaaccaaaatttcaaatactagatagccgagagtctacagagggtcctttcaaactctattaagttacccttatcattttgctcattatgtctggctggctgctgtagttgtatgttctggcagcctctttcttgaccgaccagagatgaacagcatgaaattttattagcggcaggagaatgtaagagagctttttcaggtatatatatgtatcaattttatattccgtattgctgacatgagtaaaatatctgaatagttcttttgctt

SEQ ID NO: 8 - DNA, 321 bp, Medicago trucatula
atgagacaactaggcaagaaaagcggagatgagagggacaaaattatagagaaaacaaaaacaaaagtggggaaaggcggcaacgtcggtctccttggtggtggaaggttagagtcgtcgggaactggtggtaacaatattccagtttattgtccaggattaaccgatggctcattgggtgacatgttgtcctttcattccttccacaacactggcggtcctgacaaccctggtcttaatgtggacatagtgcaaggtttttactccattctttttactctttactgcatggatgattttgaaacaattggaataaaataa

SEQ ID NO: 9 - DNA, 1802 bp, Medicago sativa; identical to SEQ ID NO: 1

SEQ ID NO: 10 - protein, 369 aa, Homo sapiens
MEGSLEREAPAGALAAVLKHSSTLPPESTQVRGYDFNRGVNYRALLEAFGTTGFQATNFGRAVQQVNAMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMRNGADYAVYINTAQEFDGSDSGARPDEAVSWGKIRVDAQPVKVYADASLVFPLLVAETFAQKMDAFMHEKNED

SEQ ID NO: 11 - protein, 368 aa, Arabidopsis thaliana
MEDDRVFSSVHSTVFKESESLEGKCDKIEGYDFNQGVDYPKLMRSMLTTGFQASNLGEAIDVVNQMLDWRLADETTVAEDCSEEEKNPSFRESVKCKIFLGFTSNLVSSGVRDTIRYLVQHHMVDVIVTTTGGVEEDLIKCLAPTFKGDFSLPGAYLRSKGLNRIGNLLVPNDNYCKFEDWIIPIFDEMLKEQKEENVLWTPSKLLARLGKEINNESSYLYWAYKMNIPVFCPGLTDGSLGDMLYFHSFRTSGLIIDVVQDIRAMNGEAVHANPKKTGMIILGGGLPKHHICNANMMRNGADYAVFINTGQEFDGSDSGARPDEAVSWGKIRGSAKTVKVYCDATIAFPLLVAETFATKRDQTCESKT

SEQ ID NO: 12 - protein, 381 aa, Solanum lycopersicum
MGEALKYSIMDSVRSVVFKESENLEGSCTKIEGYDFNKGVNYAELIKSMVSTGFQASNLGDAIAIVNQMLDWRLSHELPTEDCSEEERDVAYRESVTCKIFLGFTSNLVSSGVRDTVRYLVQHRMVDVVVTTAGGIEEDLIKCLAPTYKGDFSLPGASLRSKGLNRIGNLLVPNDNYCKFENWIIPVFDQMYEEQINEKVLWTPSKVIARLGKEINDETSYLYWAYKNRIPVFCPGLTDGSLGDMLYFHSFKKGDPDNPDLNPGLVIDIVGDIRAMNGEAVHAGLRKTGMIILGGGLPKHHVCNANMMRNGADFAVFINTAQEFDGSDSGARPDEAVSWGKIRGGAKTVKVHCDATIAFPILVAETFAAKSKEFSQIRCQV

SEQ ID NO: 13 - protein, 376 aa, Triticum aestivum
MAGEGGSGGERSKDPLEGVRAIVLKPSESLDESRFTKIAGADFNDAGLGLDGLLGSLASTGFQASNLGDAIDVVNQMLDWRLSHEKPTEDCDEAELDPKYRESVKCKIFLGFTSNLVSSGIRDVIRFLVQHHMVDVVVTTAGGIEEDLIKCLAPTYRGEFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLINGEAIHASPRKTGVIILGGGLPKHHICNANMFRNGADYAVYINTAQEFDGSDSGARPDEAVSWGKIKGSAKPVKVHCDATIAFPLLVAATFARRSHGANSTN

SEQ ID NO: 14 - protein, 376 aa, Musa acuminata
MEGGAAGGQRDRETLDAVRSVVFKPSVSLEEKRFPRVQGYDFNRGCDLIGLLDSMSTTGFQASNLGDAIDVINQMIDWRLSHDAPTEDCSEEERNLAYRQSVTCKIFLGFTSNLVSSGIREIIRFLVQHRMVEVLVTTAGGIEEDLIKCLAPTYKGDFSLPGSYLRSKGLNRIGNLLVPNDNYCKFEDWIMPILDQMLLEQTTENVVWTPSKVIARLGKEINDESSYLYWAYKNNVSVYCPALTDGSLGDMLYCHSVRNPGLLIDIVQDIRAMNGEAIHVGLRKTGVIILGGGLPKHHICNANMFRNGADYAVYVNTAQEFDGSDSGAQPDEAISWGKIKGSAKTIKVHCDATIAFPLLVAATFARKFQERNNKLA

SEQ ID NO: 15 - protein, 106 aa, Medicago trucatula
MRQLGKKSGDERDKIIEKTKTKVGKGGNVGLLGGGRLESSGTGGNNIPVYCPGLTDGSLGDMLSFHSFHNTGGPDNPGLNVDIVQGFYSILFTLYCMDDFETIGIK

SEQ ID NO: 16 - protein, 391 aa, Artificial Sequence
  Consensus sequence
  misc_feature (1)..(18): Xaa can be any naturally occurring amino acid
  misc_feature (20)..(22): Xaa can be any naturally occurring amino acid
  misc_feature (24)..(24): Xaa can be any naturally occurring amino acid
  misc_feature (26)..(26): Xaa can be any naturally occurring amino acid
  misc_feature (28)..(29): Xaa can be any naturally occurring amino acid
  misc_feature (31)..(39): Xaa can be any naturally occurring amino acid
  misc_feature (45)..(46): Xaa can be any naturally occurring amino acid
  misc_feature (48)..(52): Xaa can be any naturally occurring amino acid
  misc_feature (54)..(55): Xaa can be any naturally occurring amino acid
  misc_feature (57)..(59): Xaa can be any naturally occurring amino acid
  misc_feature (67)..(67): Xaa can be any naturally occurring amino acid
  misc_feature (69)..(69): Xaa can be any naturally occurring amino acid
  misc_feature (71)..(73): Xaa can be any naturally occurring amino acid
  misc_feature (78)..(78): Xaa can be any naturally occurring amino acid
  misc_feature (83)..(84): Xaa can be any naturally occurring amino acid
  misc_feature (86)..(89): Xaa can be any naturally occurring amino acid
  misc_feature (93)..(93): Xaa can be any naturally occurring amino acid
  misc_feature (95)..(101): Xaa can be any naturally occurring amino acid
  misc_feature (103)..(103): Xaa can be any naturally occurring amino acid
  misc_feature (106)..(106): Xaa can be any naturally occurring amino acid
  misc_feature (118)..(118): Xaa can be any naturally occurring amino acid
  misc_feature (122)..(122): Xaa can be any naturally occurring amino acid
  misc_feature (124)..(126): Xaa can be any naturally occurring amino acid
  misc_feature (128)..(128): Xaa can be any naturally occurring amino acid
  misc_feature (133)..(133): Xaa can be any naturally occurring amino acid
  misc_feature (136)..(136): Xaa can be any naturally occurring amino acid
  misc_feature (138)..(138): Xaa can be any naturally occurring amino acid
  misc_feature (142)..(142): Xaa can be any naturally occurring amino acid
  misc_feature (145)..(145): Xaa can be any naturally occurring amino acid
  misc_feature (158)..(158): Xaa can be any naturally occurring amino acid
  misc_feature (160)..(160): Xaa can be any naturally occurring amino acid
  misc_feature (166)..(167): Xaa can be any naturally occurring amino acid
  misc_feature (184)..(184): Xaa can be any naturally occurring amino acid
  misc_feature (191)..(191): Xaa can be any naturally occurring amino acid
  misc_feature (196)..(196): Xaa can be any naturally occurring amino acid
  misc_feature (201)..(202): Xaa can be any naturally occurring amino acid
  MISC_FEATURE (203)..(204): Xaa can be any of D, Q or E
  misc_feature (205)..(206): Xaa can be any naturally occurring amino acid
  misc_feature (208)..(208): Xaa can be any naturally occurring amino acid
  MISC_FEATURE (209)..(209): Xaa can be either I or V
  misc_feature (210)..(210): Xaa can be any naturally occurring amino acid
  misc_feature (225)..(225): Xaa can be any naturally occurring amino acid
  misc_feature (227)..(227): Xaa can be any naturally occurring amino acid
  misc_feature (229)..(229): Xaa can be any naturally occurring amino acid
  MISC_FEATURE (243)..(243): Xaa can be either F or Y
  misc_feature (257)..(257): Xaa can be any naturally occurring amino acid
  misc_feature (262)..(271): Xaa can be any naturally occurring amino acid
  misc_feature (276)..(277): Xaa can be any naturally occurring amino acid
  misc_feature (285)..(285): Xaa can be any naturally occurring amino acid
  misc_feature (291)..(291): Xaa can be any naturally occurring amino acid
  misc_feature (294)..(296): Xaa can be any naturally occurring amino acid
  misc_feature (300)..(300): Xaa can be any naturally occurring amino acid
  misc_feature (318)..(318): Xaa can be any naturally occurring amino acid
  misc_feature (327)..(327): Xaa can be any naturally occurring amino acid
  misc_feature (353)..(353): Xaa can be any naturally occurring amino acid
  misc_feature (355)..(355): Xaa can be any naturally occurring amino acid
  misc_feature (358)..(358): Xaa can be any naturally occurring amino acid
  misc_feature (375)..(375): Xaa can be any naturally occurring amino acid
  misc_feature (379)..(391): Xaa can be any naturally occurring amino acid
XXXXXXXXXXXXXXXXXXVXXXVXKXSXXLXXXXXXXXXGYDFNXXGXXXXXLXXSXXXTGFQASNXGXAXXXVNQMXDWRLXXEXXXXEDCXEXXXXXXXRXSVXCKIFLGFTSNLXSSGXRXXXRXLVQHXMVXVXVTTXGGXEEDLIKCLAPTYXGXFSLPGXXLRSKGLNRIGNLLVPNXNYCKFEXWIMPXLDQMXXXXXXEXXXWTPSKVIARLGKEIXNXEXSYLYWAYKNNIPVXCPGLTDGSLGDMLXFHSFXXXXXXXXXXNPGLXXDIVQDIRXINGEAXHAXXXKTGXIILGGGLPKHHICNANMXRNGADYAVXINTAQEFDGSDSGARPDEAVSWGKIXGXAKXVKVHCDATIAFPLLVAXTFAXXXXXXXXXXXXX

SEQ ID NO: 17 - DNA, 1696 bp, Arachis duranensis
aatgacaatccctaaaaccaaaaacactgaaaagtgaaaacacatcatattccactctctgccgccggcaccgcgacgattatcacctctttcagaagctcagaggaacttctcagctcgatgggtgaggcaaaggaagataatgttgttctatcttcagttcactccacagtcttcaaagaatccgaaaatctagaaggaaaatgcaccaaaattgaaggctatgacttcaaccaaggcgtcaattaccatcagcttctcaagtccatggtcaccactggctttcaagcttcaaacctaggagacgcaatccaagtcattaatcaaatgctagattggaggctcgctgatgaacctgtagtcgatgattgcagtgaggaagagagggatttgggttaccgaaggtctgttacttgcaaggtgtttctgggattcacttctaatctcatctcctctggtgtcagagacactgttcggtttctcgttcaacatcacatggttgatgtaattgtgacaactactggtggcatcgaggaagatcttataaagtgccttgcaccaacatacaaaggagatttctctctggatggagcctatctgcgctcaaagggattgaatcgtattggtaatttgttggtccctaatgacaattattgcaaatttgaggactggattattcccatttttgatcagatgttgacagaacaaaataatgagaatgtgatatggacaccatccaagttgattgctcgattgggtaaagaaataaagaatgaaagctcttacctttattgggcatacaagaacaatattccagtattttgtccgggcttaaccgatggctcattgggggacatgctgtacttccattcgttccgcaacccgggtctgattgtagacatagtgcaagatataagggccatgaatggagaagctgtacatgcgagtcctaggaagaccggcatgattattttaggaggtggtcttccaaagcatcacatctgcaatgccaatatgatgcgtaatggtgcagactacgctgtttttattaataccgcacaagaatttgatggtagtgattcgggagctcgtccagatgaagctgtttcctggggaaaaatacgaggatctgcaaaaactgttaaggtccattgtgatgcaaccatcgccttccctttgcttgttgccgaaacatttgccccaagagtgaaaccttgcaatcaatagaggttaagacaaactaactgtcaagttcgcgtaaatttcattgtttgaggacattgatgaacgtgttcaccgttggtatttgattaggtcatcatgcctggtgtgtccatcattatcgtgtgcattttatgttataccaaaaaagaaaaagtaatacactaatcctgactgcatcagagacaggaattatagatgcaataaccaattttcattggtttatgtgagttttgggatgaggatgattgtaacttctaaaacaaataacattagaaacttgaaacttcatcaactttggaagtcggtatatttttatctttcttccaactgatggccaaatttcatgttggaggaaaagatatatcacaattcagaccttatttattcttctgaatcatattgctgtgcctgtacttgtgttcttgattgtatatatggttctgaatcaaatataatgacacaatggtatttt

SEQ ID NO: 18 - protein, 368 aa, Arachis duranensis
MGEAKEDNVVLSSVHSTVFKESENLEGKCTKIEGYDFNQGVNYHQLLKSMVTTGFQASNLGDAIQVINQMLDWRLADEPVVDDCSEEERDLGYRRSVTCKVFLGFTSNLISSGVRDTVRFLVQHHMVDVIVTTTGGIEEDLIKCLAPTYKGDFSLDGAYLRSKGLNRIGNLLVPNDNYCKFEDWIIPIFDQMLTEQNNENVIWTPSKLIARLGKEIKNESSYLYWAYKNNIPVFCPGLTDGSLGDMLYFHSFRNPGLIVDIVQDIRAMNGEAVHASPRKTGMIILGGGLPKHHICNANMMRNGADYAVFINTAQEFDGSDSGARPDEAVSWGKIRGSAKTVKVHCDATIAFPLLVAETFAPRVKPCNQ

SEQ ID NO: 19 - DNA, 1583 bp, Arachis ipaensis
aatcacaatccctaaaaccaaaaacactgaaaagtgaaaacacatcatattccactctctgccgccggcaccgcgacgattatcacctctttcagaagctcaggtagtatcatagcacgtttgtgctcctcgtactgtgttgcaattttcacaagaacttctcagcttgggattcagctcgatgggtgaggcaaaggaagataatgttgttctatcttcagttcactccacagtcttcaaagaatccgaaaatctagaaggaaaatgcaccaaaattgaaggctatgacttcaaccaaggcgtcaattatcatcagcttctcaagtccatggtcaccactggctttcaagcttcaaacctaggagacgcaatccaagtcattaatcaaatgctagattggaggctcgctgatgaaccagtagtcgatgattgcagtgaggaagagagggatttgggttaccgaaggtctgttacgtgcaaggtgtttctgggattcacttctaatctcatctcctctggtgttagagacactgttcggtttctcgttcaacatcacatggttgatgtaattgtgacaactactggcggcattgaggaagatcttataaagtgccttgcaccaacatacaaaggagatttctctctggatggagcctatctgcgctcaaagggattgaatcgtattggtaatttgttggtccctaatgacaattattgcaaatttgaggactggattattcccatttttgatcagatgttgacagaacaaaataatgagaatgtgatatggacaccatccaagttgattgctcgattgggtaaagaaataaagaatgaaagctcttacctttattgggcatacaagaacaatattccagtattttgtccgggcttaaccgatggctcattgggggacatgctgtacttccattcgttccgcaacccgggtctgattgtagacatagtgcaagatataagggccatgaatggagaagctgtacatgcgagtcctaggaagaccggcatgattattttaggaggtggtcttccaaagcatcacatctgcaatgccaatatgatgcgtaatggtgcagactacgctgtttttattaataccgcacaagaatttgatggtagtgattcgggagctcgtccagatgaagctgtttcctggggaaaaatacgaggatctgcaaaaactgttaaggtccactgcgatgcaaccatcgccttccctttgcttgttgccgaaacatttgccccaagagtgaaaccttgcaatcaatagaggttaagacaaactaactgtcaagtttgcgtaaattgcattgtttgaggacattgatgaacgtgttcaccgttggtattcgattaggtcaacatgcctgtattcgatcggtatctccatcactatcgtgtgcattttatgttataccataaaagaaaaagtaatacactaattctgactgcatgagagacaggaattatagatgcagtaaccaattttcattgatttatgtgagttttgggatgaggatgattgtaacttctaaaacaaataacattagaaacttgaaagttca

SEQ ID NO: 20 - protein, 368 aa, Arachis ipaensis; identical to SEQ ID NO: 18

SEQ ID NO: 21 - DNA, 1182 bp, Glycine max
atggctcaaacgttaaaacttaaaacacgtctgtctctgttttgtggtgagaagaagagagagacagacagaacaatgggggaagcaaagggaaaggaagaagaagtgttagcatcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgctagactggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaatgtgttgtggacaccatctaagttaatagctcgattgggaaaagaaataaaaaatgaaagctcttacctttactgggcatacaagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacactgtgatgcaacaatagcatttcctctgctggttgctgaaacgtttgcttcaagagtgaaacctcaccattga

SEQ ID NO: 22 - protein, 393 aa, Glycine max
MAQTLKLKTRLSLFCGEKKRETDRTMGEAKGKEEEVLASVHSTVFKESESLDGKCVKIEGYDFNRGVNYPLLLSSMVTTGFQASNLGDAIQVVNQMLDWRLVDEPVAEDCSDQERDLEYRKSVTCKVFLGFTSNLISSGVRDTVRFLLQHRMVDVVVTTTGGIEEDLIKCLAPTYKGDFSLPGAYLRSKGLNRIGNLLVPNDNYCKFEDWIIPIFDQMLGEQNNENVLWTPSKLIARLGKEIKNESSYLYWAYKNNIPVFCPGLTDGSLGDMLYFHSFRNPGLIVDIVQDIRAMNGEAVHASPRKTGMIILGGGLPKHHICNANMMRNGADYAVFINTAQEYDGSDSGARPDEAVSWGKIRDSAQTVKVHCDATIAFPLLVAETFASRVKPHH

SEQ ID NO: 23 - DNA, 1155 bp, Glycine max
atggctcaaacgttaaaacttaaaacacgtctgtctctgttttgtggtgagaagaagagagagacagacagaacaatgggggaagcaaagggaaaggaagaagaagtgttagcatcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatgctagactggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgagaatgtgttgtggacaccatctaagttaatagctcgattgggaaaagaaataaaaaatgaaagctcttacctttactgggcatacaagaacaacattccagttttctgtccgggcttaactgatggctcattgggggacatgctgtacttccattccttccgcaatcctggtctgattgtggacatagtgcaagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacatcctatgcaaactttcacaactggtttccttgtcatagttctttaa

SEQ ID NO: 24 - protein, 384 aa, Glycine max
MAQTLKLKTRLSLFCGEKKRETDRTMGEAKGKEEEVLASVHSTVFKESESLDGKCVKIEGYDFNRGVNYPLLLSSMVTTGFQASNLGDAIQVVNQMLDWRLVDEPVAEDCSDQERDLEYRKSVTCKVFLGFTSNLISSGVRDTVRFLLQHRMVDVVVTTTGGIEEDLIKCLAPTYKGDFSLPGAYLRSKGLNRIGNLLVPNDNYCKFEDWIIPIFDQMLGEQNNENVLWTPSKLIARLGKEIKNESSYLYWAYKNNIPVFCPGLTDGSLGDMLYFHSFRNPGLIVDIVQDIRAMNGEAVHASPRKTGMIILGGGLPKHHICNANMMRNGADYAVFINTAQEYDGSDSGARPDEAVSWGKIRDSAQTVKVHPMQTFTTGFLVIVL

SEQ ID NO: 25 - DNA, 1516 bp, Zea mays
gctgtctcacggctgcggctgcggctgcggcggttcgggctcctcctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccgtcggactcgaggggctgctcgcctcgctcgcgtccaccgggttccaggcatccaacctcggcgacgccatcgacgtcgtcaaccagatgttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgagaatgtttggacaccgtcgaaggtgatagcgcgccttggcaaagaaataaatgatgaaagctcctatctttattgggcatacaagaataacatccctgtatactgcccagcattgactgatggatcacttggagacatgctgttctgtcatgcagttcgtaatcctggccttattattgacattgtacaagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtgcattgcgatgcaagtatcgctttcccgcttcttgttgcagcaacatttgcacgtaaggttcataactccaaatgaacagactgaatgggattcagtggagtgaatgggcaacagaattttgttgaactctccaaatgacctttttggagcacgaggtctacttcacctgcacagggatcatgtgcaagttttttcggtgactcgcggcaaccacatgccataattcttcgatgttcacttgatgctgtactagctggttgatagcatttttgttacaacagataatttattgaaatacagacatacgattgttcatccgagtcgtctgcttacgaattttttgtagacgaaacatctgcttacgaaattaacaaatggcctgttttatgaacacgttttttgaaaaaaaaaaaaaaaa

SEQ ID NO: 26 - protein, 370 aa, Zea mays
MAAGAGGGELEALEGVRSIVLKPSESLDESRFTRIAGADFNDPAVGLEGLLASLASTGFQASNLGDAIDVVNQMLDWRLSHEKPSEDCDEAELDPKYRASVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLQEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHNSK

SEQ ID NO: 27 - DNA, 1494 bp, Zea mays
ccttgtgttttcatcctccttgaagcgaaaacgatcgagcttgtatcgcaggcatttcggtacactacgttctccggctgtgtagagcttctgcggagatgggtgccgagttgggagaagcgggtgtccctgcccgggacatggtggacgcgctggaaggcgtgcgctccatcctgctgaaaccgtcggagcgcctcgacgacaagcgcttcacgaggatcgccggcgccgacttcgacgacgccggcctcggcctcgccgggttgctcggctcgctcgcgtccacggggttccaggcctccaacctcggcgacgccatcgacgtcgtcaaccagatgttggactggaggttgtcccacgagaagccaagcgacgactgcgctgaagctgaactcgatcctgcgtacagagaatccgtcaagtgcaagatattcctggggttcacttcgaaccttgtgtcttccggtgttcgggagatcatccggtttcttgttcagcatcgcatggtggacgttattgttacgactgctgggggtatagaggaggacctcatcaaatgccttgcgccaacctacagaggcgacttcactctgcccggagcgctgctgcggtccagaggacttaaccggataggaaacctgctggtgcccaatgacaactactgcaagttcgagcactggatcatgccgatcctcgacaagatgctgctggaacagtccacccaaaatgtttggacgccgtccaaggtgattgctcgccttggcaaggaaataaatgacgaaagctcctacctttattgggcgtacaagaacaacatccctgtgttctgcccagcattgactgacggatcaattggggacatgctgttctgtcactcggttcacagtccaggtcttgttgtcgacattgtacaagatgtacggctgatgaacgcggaaaccatccacgcaagcccaaggaagacagggattatactccttggcggaggccttccgaagcatcatatatgcaacgccaatatgctgcgcgacggagctgactatgcggtgtatgtcaacacagctcaggagttcgatggcagtgattccggggcgcggcctgacgaagcggtttcatggggaaagatcaagagctcagcgagaactgtgaaggtgcattgtgatgcgacgattgcctttccacttcttgtggctgcaacatttgcacgcaaggttcacggcactaaatcaacaaactgaatcggaggcagtgaaattaaaatatggcgctctataactagctgaaactttcctcatatgatggttgagcttgaagcatgaacttttatttgcttgaagggtgtctatctcttagctcgtttactatttatacattactgtaacatatgtatgatatatattcatttgaaaccatttgggttattatcatacaataaaacttgtgtgtacgagaacatttgtgaccctctcttcaaattctcaaaattgttgctct

SEQ ID NO: 28 - protein, 379 aa, Zea mays
MGAELGEAGVPARDMVDALEGVRSILLKPSERLDDKRFTRIAGADFDDAGLGLAGLLGSLASTGFQASNLGDAIDVVNQMLDWRLSHEKPSDDCAEAELDPAYRESVKCKIFLGFTSNLVSSGVREIIRFLVQHRMVDVIVTTAGGIEEDLIKCLAPTYRGDFTLPGALLRSRGLNRIGNLLVPNDNYCKFEHWIMPILDKMLLEQSTQNVWTPSKVIARLGKEINDESSYLYWAYKNNIPVFCPALTDGSIGDMLFCHSVHSPGLVVDIVQDVRLMNAETIHASPRKTGIILLGGGLPKHHICNANMLRDGADYAVYVNTAQEFDGSDSGARPDEAVSWGKIKSSARTVKVHCDATIAFPLLVAATFARKVHGTKSTN

SEQ ID NO: 29 - DNA, 1906 bp, Oryza sativa Japonica Group
tggcggcgccgccggccgcccccacctcaccttccgccgcctttgcctcccgctttctccaagcgcggcagcgccgccgccgccgccgccccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggaggagggggagtgcgcgacatggacgcgctggagggcgtgcgctcaatcgtgttgaagccctcggagtccctcgacgaggggcggttcacgaggatcgccggcgccgacttcaacgacgccggcctcggcctccccgggctgctcgcgtcgctcgccaccaccggattccaggcctccaacctcggcgacgccgtcgacgtcgtcaaccagatgttagattggaggctgtctcacgagaagccacgtgaggactgtgatgaagctgagcttgatcctacatatagagaatctgtaaagtgcaaaatattcctgggattcacttcaaaccttgtctcttctggcattcgagatgtagtccgttttctagttcagcatcacatggtggatgttattgttacaactgctggtggtatagaggaggatctcatcaaatgtcttgctcccacttatagaggagaattttctttacctggaacactgttgcggtcaaagggattgaatcggattggaaatcttttggttcccaatgataactattgcaagtttgagaactggatcatgccactttttgatcagatgctacaagagcaatccactgagaatgtttggacaccatcgaaggtcatagcttgtcttggcaaagaaataaatgatgaaagttcctacctttattgggcgtataagaacaatattcctgtatactgcccagcattgactgatggatcgcttggagacatgctattctgtcatgcagtccgcaatcctggcctaattattgacattgtacaagatataagattgatgaatggggaagccattcatgcaaccccaaggaagacagggatcatagttcttggtggaggtctacccaagcatcatatatgcaacgccaatatgtttcgcaatggtgcagattatgcagtctatatcaacacagcccaagagtttgatggcagtgattctggagcacaacctgatgaagcagtttcatggggaaagattaaaggttcagccaaacccgtcaaggtgcattgtgacgctacgatcgctttcccattaattgtggctgcaacattcgcacgcaagtttcacggtgcgaaacaagcgaactgaatttctgggtttgagctaaaccgattcctgtcgaattcgtctccccaagttgagtgttcagacctcggagcacggcttgtacatcccttctcagggatggagcaggaaggttttgttggtagtaaaatggtacttactcacgaactgtacggccatgcttgatcatctttcttcattgtgcacattcgatcatctttcttcgtggtacaccactgaggctgtagtagcattttgcttgcgtgttgcaggggacacttcatggaagttaagacattgttcgctttgttcatccgctgttcggatgatttctgactagtgcaagagggaaaaggatatttatctcacagaccgttttggatatgtacgcattcagcgagaacaaatgggtatatgtaatttgaattccgtatcaattgttttgctaggaaacaggaaaggagggaaaatgaaaaacaggagtccaagcagattttcttcggtaca

SEQ ID NO: 30 - protein, 375 aa, Oryza sativa Japonica Group
MAGAGGGGVRDMDALEGVRSIVLKPSESLDEGRFTRIAGADFNDAGLGLPGLLASLATTGFQASNLGDAVDVVNQMLDWRLSHEKPREDCDEAELDPTYRESVKCKIFLGFTSNLVSSGIRDVVRFLVQHHMVDVIVTTAGGIEEDLIKCLAPTYRGEFSLPGTLLRSKGLNRIGNLLVPNDNYCKFENWIMPLFDQMLQEQSTENVWTPSKVIACLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAQPDEAVSWGKIKGSAKPVKVHCDATIAFPLIVAATFARKFHGAKQAN

SEQ ID NO: 31 - DNA, 1661 bp, Gossypium hirsutum
ggttatcaaactagcttttgttgcacgcagcctcaacctcagcactctgctcccattcttcagctactctttttcttcatatcccatctccgccaccgttatcttctcatcttcaccgcaccgccaccgtctactggcgacaaccctgcaattaagtattcttgatacaataaagcaatctacgcattgtggcagttttctttgcgaaggacgaaaggcggtaaaaggagataatggatgataagcttgtaaactctgtacgctctactgttttcaaagactcagattcccttgaagggacttgcactagaattgaaggttatgatttcaatcagggtgtaaactactccaggcttctcaaatccatgctttccactggatttcaagcttccaattttggagaagctgttgaaattgtcaatgagatgttagattggaggctttctgatgagcctatagctgaggacagcagtgaagaggagaaggatcctacctacagagaatctgtgagatccaaggtgtttttggggttcacatcaaatcttatttcatctggtgttcgagacactgttcgatatcttactgagcatcacatggtagatgtaatagttactacaactggtggcatagaagaagatcttataaaatgtcttgctccaacatataagggtgatttttcgttacctggtgctcagttacgttcaagaggattgaatcgcattggtaacttgttggttcctaatgacaattactgcaaatttgaggattggatcattccaatttttgatcagatgttgaaggaacagcatgaagagaatgtgttgtggactccatcaaagttaattgcacgtttgggacaagaaataaataatggagattcatacctctactgggcatacaagaacaatattcctgttttctgtcctggattaacagatggctctttaggggatatgttgtattttcattcttttcgcaacccaggtctgataattgatgtagtgcaagatattagggccatgaatggtgaagcagtccatgcaagtcctaggaaaacaggaatgattattctaggagggggattgccgaagcatcatatctgtaatgctaatatgatgcgtaatggtgccgattatgctgtttacataaatactgctcaagagtatgatgggagcgattccggagcccgcccagatgaagctgtttcatgggggaaaatacgaggctctgctaaaacagttaaggtacattgtgatgcaactattgctttccctcttctggtagctgaaacatttgcttcgaggtcgaaaaattttgtggcctagtaccatttttttcaaccgcacagattcatctaaatatcttattatttatctctgtggtggcatcctaatgaagacagatgatttctcatgatattatttatcaggtaacttgtacttttccatggtaaccaaaccatgctgagagttgtcgaaatttgttttaaagggagagtttattatagtgtagaagagtcagacgaatctgttatcactctttctagttcgttgtataagaattttggttgtagtgtagatgctattgatgaaattgctttcattttatggcaatatgtcaccattatcctctcctaatgcacccatctgatggttgaagaa

SEQ ID NO: 32 - protein, 363 aa, Gossypium hirsutum
MDDKLVNSVRSTVFKDSDSLEGTCTRIEGYDFNQGVNYSRLLKSMLSTGFQASNFGEAVEIVNEMLDWRLSDEPIAEDSSEEEKDPTYRESVRSKVFLGFTSNLISSGVRDTVRYLTEHHMVDVIVTTTGGIEEDLIKCLAPTYKGDFSLPGAQLRSRGLNRIGNLLVPNDNYCKFEDWIIPIFDQMLKEQHEENVLWTPSKLIARLGQEINNGDSYLYWAYKNNIPVFCPGLTDGSLGDMLYFHSFRNPGLIIDVVQDIRAMNGEAVHASPRKTGMIILGGGLPKHHICNANMMRNGADYAVYINTAQEYDGSDSGARPDEAVSWGKIRGSAKTVKVHCDATIAFPLLVAETFASRSKNFVA

SEQ ID NO: 33 - DNA, 1620 bp, Beta vulgaris subsp. vulgaris
aacttacttttagaattcttctcaaaacaaaaaaaaaaaaaaaaacaaaacttgcttttacaatagttttcagggttttagtctgagagctcaatctgtgaatcttaaacccttttcctcaaactgtgatttctgttgcaaaattatctcaactactcaaattatcttctcatagtttcaattaaagaaacgaaaatggaagacaatactatggcatcggttcactccacagttttcaaagaatcagaaaccctagaaggaaaatgcatcaaaattcagggctatgatttcaatcaaggagtaaattattcgcaactcgtaaaatctttcatttccactggtttccaagcatcaaatcttggagaagccattgaagtagtaaatcaaatgctagattggaggctttcagatgaagtacctgccgaagactgtagtatggaggagagcgattctgattacagaaattctgtgaggtgcaaaatattccttgggtttacatcaaatttaatttcatctgggattcgtgacacggttcgatatcttgttcagaatcatatggttcatgtgattgctacaactgctggtgggatagaagaagatcttattaaatgtcttgcacctacatttagaggtgaattttctctacctggagctcaattacgttcaaaaggattgaatcggattggtaatttgttggttcccaatgacaactactgcaaatttgaggattggattattcccatatttgataaaatgttaaaggagcaaaattcagagaagattacatggacaccatctaaggtgattgctcgtttggggaaagaaattgatgatgaaagttcatatctttattgggcgtacaagaacaatattcctgtcttctgccctggtttaacagatggatcactaggggatatgttatattttcattcattccgcaacccaggtttaattattgatattgtgcaagatattagggcgatgaacggtgaggctgttcatgcagctcctaggaagactggagtgatagttcttgggggtggattgccaaagcatcatatttgcaatgccaatatgatgcgtaatggcgcagattatgcagtttttgtcaatactgctcaggagtttgatggtagtgattcaggtgctcgtcctgatgaggccgtgtcctggggaaagattcgaggatctgcaaagactgttaaggtgcactgtgatgctactattgcttttcctctattagttgctgagacttttgctgctaagagaaaaaattaaagctgatgcccgtttctgatctcaaagggttgccttttgtttcaagttattgatacaatttggagcatgctgctgaagtaacatggaatgtgtcaatccataaactcgaggggtgaaataaggttgctgttggcatgattttcccttttttttaccattcttgttggttttcttttgagattaatcactcacaaagccaataccaacttcgttagcagattctttgttcacagcaatttgtaaccctaatatattggctaatatctgtatacagaaacaaattttacgcgagttggatttcgaaactttgttctacctttacaaaggagtgtttgtccttta

SEQ ID NO: 34 - protein, 360 aa, Beta vulgaris subsp. vulgaris
MEDNTMASVHSTVFKESETLEGKCIKIQGYDFNQGVNYSQLVKSFISTGFQASNLGEAIEVVNQMLDWRLSDEVPAEDCSMEESDSDYRNSVRCKIFLGFTSNLISSGIRDTVRYLVQNHMVHVIATTAGGIEEDLIKCLAPTFRGEFSLPGAQLRSKGLNRIGNLLVPNDNYCKFEDWIIPIFDKMLKEQNSEKITWTPSKVIARLGKEIDDESSYLYWAYKNNIPVFCPGLTDGSLGDMLYFHSFRNPGLIIDIVQDIRAMNGEAVHAAPRKTGVIVLGGGLPKHHICNANMMRNGADYAVFVNTAQEFDGSDSGARPDEAVSWGKIRGSAKTVKVHCDATIAFPLLVAETFAAKRKN

SEQ ID NO: 35 - DNA, 1411 bp, Brassica rapa
tggttgtgtctttttccctgtctgctactagcttgctagaaccctaaaactccctcccaaaactctccacatcttccgagaaagaagatggaggaggatcgtgttctctcatctgttcactccaccgtcttcaaggaatccgaatcgttagaaggaaagtgcgacaaaatcgaaggatacgatttcaaccaaggagtaaactaccccaagcttctccgatccatgctcacaacgggcttccaagcctcaaacctcggcgaagctattgatgtcgttaatcaaatgctagagtggagactctctgatgaaactatagcacctgaagactgtagtgaagaggagaaggacccagcgtatagagagtccgtgaagtgtaaaatctttctaggcttcacttcgaatcttgtttcctctggtgttagagagactattcgataccttgttcagcatcatatggttgatgttatagttactacaactggtggcgtagaggaagatctcatcaaatgccttgctcctactttcaaaggtgatttctctctaccgggtgcgtatcttcggtcaaagggattgaaccggatcgggaacttgcttgttccgaatgataactactgcaagtttgaggattggatcattcccatctttgaccagatgttgaaggaacagaaagaagagagtgtgttgtggacgccttctaaattgttagcgcggctggggaaagaaataaataatgagagttcatatctttattgggcatacaagatgaatattccagtgttctgcccggggttaaccgatggctctctcggtgatatgttgtattttcactcattccgtacctctggccttgtcattgacgtagtgcaagatatcagagctatgaacggtgaagcagtccatgctactccaagaaagacagggatgataatccttggagggggcttgccgaagcaccacatatgtaatgccaacatgatgcgtaacggtgcggactacgctgtgttcataaacacagggcaagagtttgatgggagtgactctggtgcacgccctgatgaggcagtgtcttggggtaaaataaggggatctgctaaaaccgttaaggtatactgtgatgctactatagccttccctttgttggttgcagaaacatttgcctccaagagagaacaaaactgtgagcacaagacctaagcccaagaaagcttacgtctcatttatcggtttgttcttccatcttgttgttgtaccctttgtcctgctttacataacattcatctctaaaacaatactacctccttttgacaaaaaaaaaaattggaaaaaatggtttcacaagaataatatttttatgtgctcaataaattttgtattatttaatgacagtaaattgttaatgttagaagattaa

SEQ ID NO: 36 - protein, 368 aa, Brassica rapa
MEEDRVLSSVHSTVFKESESLEGKCDKIEGYDFNQGVNYPKLLRSMLTTGFQASNLGEAIDVVNQMLEWRLSDETIAPEDCSEEEKDPAYRESVKCKIFLGFTSNLVSSGVRETIRYLVQHHMVDVIVTTTGGVEEDLIKCLAPTFKGDFSLPGAYLRSKGLNRIGNLLVPNDNYCKFEDWIIPIFDQMLKEQKEESVLWTPSKLLARLGKEINNESSYLYWAYKMNIPVFCPGLTDGSLGDMLYFHSFRTSGLVIDVVQDIRAMNGEAVHATPRKTGMIILGGGLPKHHICNANMMRNGADYAVFINTGQEFDGSDSGARPDEAVSWGKIRGSAKTVKVYCDATIAFPLLVAETFASKREQNCEHKT

SEQ ID NO: 37 - DNA, 1389 bp, Brassica napus
ggttgtgtctttttccctgtctgctagcttgctagaaccctaaaactccctcccaaaactctccacatcttccgagaaagaagatggaggaggatcgtgttctctcatctgttcactccaccgtcttcaaggaatcagaatcgttggaaggaaagtgcgacaaaatcgaaggatacgatttcaaccaaggagtaaactacccgaagcttctccgatccatgctcacaaccggcttccaagcctcgaatctcggcgaagctattgatatcgttaatcaaatgctagagtggagactctctgatgaaactatagcacctgaagactgtagtgaagaggagaaggatccagcgtatagagagtccgtgaagtgtaaaatctttctaggcttcacttcgaatcttgtttcgtctggtgttagagagactattcgataccttgttcagcatcatatggttgatgttatagttactacaactggtggcgtagaggaagatcttatcaaatgccttgctcctactttcaaaggtgacttctctctaccgggtgcgtatcttcggtcaaagggattgaaccggatcgggaacttgcttgttccgaatgataactactgcaagtttgaggattggatcattcccatctttgaccagatgttgaaggaacagaaagaagagaatgtgttgtggacaccttctaaactgttagcgcgtttgggaaaagaaataaacaatgagagttcatacctttattgggcatacaagatgaatattccagtattctgcccggggttaacagatggctctctcggtgatatgctctattttcactcctttcgtacctctggccttgtcatcgatgttgtgcaagatatcagagctatgaacggagaagctgtccatgctactccaagaaagacagggatgataatcctcggaggcggcttgccgaagcaccacatatgtaatgccaacatgatgcgtaacggtgcggactacgctgtgttcataaacacagggcaagagtttgatgggagtgactctggtgcacgccctgatgaagcagtgtcttggggtaaaataagggggtctgctaaaaccgttaaggtatactgtgatgctaccatagcctttcctttgttggttgctgaaacatttgcctccaagagagaacaaaactgtgagcacaagacctaagcccaagaaagcttacgtctcttttatcggtttgttcttccatcttgttgttgtaccctttgtcctgctttacataacattcatctctaaaacaatactacctccttttgacaaaaaataaaaaaaattggaaaaatggtttcacaagaataatatttttgtgtgctcaataaattttgtattatttaatgacagtaaa

SEQ ID NO: 38 - protein, 368 aa, Brassica napus
MEEDRVLSSVHSTVFKESESLEGKCDKIEGYDFNQGVNYPKLLRSMLTTGFQASNLGEAIDIVNQMLEWRLSDETIAPEDCSEEEKDPAYRESVKCKIFLGFTSNLVSSGVRETIRYLVQHHMVDVIVTTTGGVEEDLIKCLAPTFKGDFSLPGAYLRSKGLNRIGNLLVPNDNYCKFEDWIIPIFDQMLKEQKEENVLWTPSKLLARLGKEINNESSYLYWAYKMNIPVFCPGLTDGSLGDMLYFHSFRTSGLVIDVVQDIRAMNGEAVHATPRKTGMIILGGGLPKHHICNANMMRNGADYAVFINTGQEFDGSDSGARPDEAVSWGKIRGSAKTVKVYCDATIAFPLLVAETFASKREQNCEHKT

SEQ ID NO: 39 - DNA, 1131 bp, Sorghum bicolor
atggccggcgcgggaggcagcgggggcggcggcgtggtccgcgacgtggaggcgctggacggcgtgcgctccatcgtgctaaagccttcggagtcgctcgacgagtcgcggttcaccaggatcgccggcgccgacttcaacgacccgggcctcggactcgaggggctgcttgcctcgcttgcgagcacggggttccaggcatccaacctcggcgacgccatcgacgtcgtcaaccagatgttagattggaggttatctcatgagaagcccagtgaggattgtgatgacgctgaacttgaccctaaatatagagaatctgtgaaatgcaagatatttctgggcttcacttcaaacctcgtgtcttctggcatccgggatataatccgttttctagctcagcatcacatggtggatgttattgttacaagtgctgggggtatagaggaggatctcattaaatgccttgcaccaacttatagaggtgatttttctttacctggagcactgctgcggtcaaaaggactgaaccggataggaaatctgttggtgcccaacgataactattgcaagtttgagaactggatcatgccactctttgaccagatgcttctggagcaatctactgagaatgtttggacaccgtcaaaggtgatagctcgtcttggcaaagaaataaatgatgaaagctcctatctttattgggcatacaagaataacattcctgtatactgcccagcgttgactgatggatcacttggagacatgctgttctgtcatgcagttcgtaatcctggccttattattgacattgtacaagatatacgactgatgaatggggaagccatccatgcaacaccaaggaagacagggattatagttcttggtggaggacttccaaagcatcatatatgcaatgccaatatgttccgcaatggtgcagattatgctgtctatattaacacggcccaagagtttgatggtagcgattccggagcacaccctgatgaagcagtctcatggggcaagatcaagggttcagcaaaacctgtaaaggtgcactgcgatgcaagcatcgctttcccgcttcttgttgctgcgacatttgcacgtaaggttcacagctccaaatga

SEQ ID NO: 40 - protein, 376 aa, Sorghum bicolor
MAGAGGSGGGGVVRDVEALDGVRSIVLKPSESLDESRFTRIAGADFNDPGLGLEGLLASLASTGFQASNLGDAIDVVNQMLDWRLSHEKPSEDCDDAELDPKYRESVKCKIFLGFTSNLVSSGIRDIIRFLAQHHMVDVIVTSAGGIEEDLIKCLAPTYRGDFSLPGALLRSKGLNRIGNLLVPNDNYCKFENWIMPLFDQMLLEQSTENVWTPSKVIARLGKEINDESSYLYWAYKNNIPVYCPALTDGSLGDMLFCHAVRNPGLIIDIVQDIRLMNGEAIHATPRKTGIIVLGGGLPKHHICNANMFRNGADYAVYINTAQEFDGSDSGAHPDEAVSWGKIKGSAKPVKVHCDASIAFPLLVAATFARKVHSSK

SEQ ID NO: 41 - DNA, 1564 bp, Solanum tuberosum
gcggcagtggtgttccgtacataatcttcgtctgcaataatgggtgaggctctgaaggacaatatcatggactcagtaagatcggtagttttcaaagaatccgaaaatctagaaggctcttgcacaaaaatcgagggctacgacttcaataaaggcgttaactatgctgagcttatcaagtccatggtttccactggtttccaagcttcaaatcttggtgacgccattgaaattgttaatcaaatgctagattggaggctttcacatgagctgctcatggaggattgcagcgaagaagaaagagatgttgcatacagagagtcggtaacctgcaaaatctttttggggttcacttcaaaccttgtttcttctggtgttagagacactgtccgctaccttgttcagcaccgaatggttgatgttgtggttactacagctggtggtattgaagaggatctcataaagtgccttgcaccaacctacaagggggatttctctttatctggagctgctctacgatcgaaaggattgaaccgtattggtaacttattggttcctaatgacaactactgcaaatttgagaattggatcatcccaatttttgatcaaatgtatgaggagcagattaatgagaaggttctatggacaccatctaaagtcattgctcgcctgggtaaagaaattaatgatgaaacctcatacttgtattgggcttacaagaaccggattcctgtcttctgtcctggcttgacggatggatcacttggtgacatgctatacttccattctttcaaaaagggagatccagatcttaatcctggtctagtcatagacgttgttggagatattagggccatgaatggtgaagctgtccatgctggtttgaggaagacaggaatgattatactgggtggagggctgcctaagcaccatatttgcaatgccaatatgatgcgcaatggtgcagattttgccgtcttcattaacactgcacaagagtttgatggtagtgactctggtgcccgtcctgatgaagctgtatcatggggaaagatacgtggtggcgccaagactgtgaaggtgcattgtgatgcaacaattgcatttcccatattagtagctgagacatttgcagccaagagtaaggaattctcccagataaggtgccaagtttgaacatagaggaagctgtccttccaaccacacatatgaattgctagcttttgaagccaacttgctagtgtgcagcatcatttattctgcaagactgactagagagcagggtatattcctgtaccccgagttagacgacatcctgtatggttcaaattaattatttttctccccttcacaccatgttatttagttctcttcctcttctaaagtgaagagcttagatgttcataggttttgaatcatgttgtatcatattttgagttttggaggttggtgataactgacaagtcctcttaccatatatatgatggatccttgtactatgagatttagggtgtgtttggtacgaaggaaaatggtttttggaaacaagtggattttaaattta

SEQ ID NO: 42 - protein, 378 aa, Solanum tuberosum
MGEALKDNIMDSVRSVVFKESENLEGSCTKIEGYDFNKGVNYAELIKSMVSTGFQASNLGDAIEIVNQMLDWRLSHELLMEDCSEEERDVAYRESVTCKIFLGFTSNLVSSGVRDTVRYLVQHRMVDVVVTTAGGIEEDLIKCLAPTYKGDFSLSGAALRSKGLNRIGNLLVPNDNYCKFENWIIPIFDQMYEEQINEKVLWTPSKVIARLGKEINDETSYLYWAYKNRIPVFCPGLTDGSLGDMLYFHSFKKGDPDLNPGLVIDVVGDIRAMNGEAVHAGLRKTGMIILGGGLPKHHICNANMMRNGADFAVFINTAQEFDGSDSGARPDEAVSWGKIRGGAKTVKVHCDATIAFPILVAETFAAKSKEFSQIRCQV

SEQ ID NO: 43 - DNA, 1396 bp, Camelina sativa
agcaaaaagattcgtttgaagatggtcatcttttattccgtttaatctagaaccctagaacacccccaaaaacccttccagatccagcgaaatcgattttggtcttggagcaaagatggaggatcgtgttttctcttcggttcactcaacggttttcaaagaatccgaatcgctagaagggaagtgtgacaaaatcgaaggatacgatttcaatgagggagtaaattacccaaagcttatgcgatccatgctcaccactggctttcaagcctcaaatctcggcgaagctattgacgtcgtcaatcaaatgctagactggagactggctgatgaaaccacagtagctgaagactgtagtgaagaggagaaagacccatcttatagagagtctgtgaaatgtaaaatctttcttggtttcacttcgaatcttgtttcatctggtgttagagacactattcgatatcttgttcagcatcatatggttgatgttatagtcactacaactggtggcgtagaggaagatctcatcaaatgccttgcacctacatttaaaggtgatttctctctacctggcgcttatctacggtctaagggattgaaccgaattgggaacttgctggttcctaatgataactactgcaagtttgaggattggatcattcccatctttgacgagatgttgaaggaacagaaagaagagaatgtgttgtggacaccttctaaactgttagcacgacttggaaaagaaataaacaatgagagttcatacctttattgggcatacaagatgaatattccagtattctgcccggggttaacagatggctctcttggcgatatgctgtattttcactcctttcgtacctctggccttgtcattgatgtagtgcaagatatcagggctatgaatagtgaagctgtccatgcaagtccaagaaagacagggatgataatccttggagggggcataccgaagcaccacatatgtaatgccaatatgatgcgtaacggtgcagattacgccgtgttcataaacaccgggcaggaatttgatgggagcgactcgggtgcacgccctgatgaagccgtatcttggggtaaaataaggggatctgctaaaaccgtgaaggtgtactgtgatgctaccatagctttccctttgttggtggctgaaacatttgccacaaagagagaacaaacctgtgagtctaaaacgtaaagaactgactgtcgtttaggccagtaaaacactccacattgatgaaatagtacccataaaacactgtggctgtgacccaaattgtcgccttgcagaatgtactttattgtttgctctgattttaaaatgattaagattgtctttgattgattaaacacacaagagttttgtggtcaa

SEQ ID NO: 44 - protein, 367 aa, Camelina sativa
MEDRVFSSVHSTVFKESESLEGKCDKIEGYDFNEGVNYPKLMRSMLTTGFQASNLGEAIDVVNQMLDWRLADETTVAEDCSEEEKDPSYRESVKCKIFLGFTSNLVSSGVRDTIRYLVQHHMVDVIVTTTGGVEEDLIKCLAPTFKGDFSLPGAYLRSKGLNRIGNLLVPNDNYCKFEDWIIPIFDEMLKEQKEENVLWTPSKLLARLGKEINNESSYLYWAYKMNIPVFCPGLTDGSLGDMLYFHSFRTSGLVIDVVQDIRAMNSEAVHASPRKTGMIILGGGIPKHHICNANMMRNGADYAVFINTGQEFDGSDSGARPDEAVSWGKIRGSAKTVKVYCDATIAFPLLVAETFATKREQTCESKT

SEQ ID NO: 45 - DNA, 1451 bp, Populus deltoides
gggatttatgacaggcaaaaaacaatgggaggaagatttgctatcatcagtacggaccacagtgtttaaagaatcagaagctcttgatgggaaatgcattaaaattgaaggttatgattttaatcaaggagtgaactactctaagcttctcaaatccatggtctctaccgggtttcaagcttccaaccttggagatgccattcaagttgttaataacatgctagactggaggcttgctgatgaagagataacagaagattgtagtgatgaggagagggagttggcctatagagagtctgtgagatgcaaactgttcttgggttttacatcaaatcttgtttcttcaggtgtcagagatacaattcgatatcttgttcagcatcatatggttgatgtagtggttacaacggcaggtggcatagaagaagatcttataaaatgcctggcaccaacatacaaaggtgacttttctctacccggggctcaattacgatcaaaagggttgaatcgaattggtaacttgttggtacctaatgacaactactgcaaatttgaggattggatcattccaatctttgaccaaatgttgaaggaacaaattgaagagaatatcacctggacaccttctaaattaatagctcgcatggggaaagaaataaataatgagagttcatacctttattgggcatataagaacgacattccagtattctgtccaggcttaacagatggttctctaggggacatgctatactttcattccttccacaaccctggtctaattgttgccatagtccaagatattagagccatgaatggtgaagctgtccacgcaagtcctagaaaaactggtatcatcattcttggaggtgggcttcctaagcatcatatatgcaatgccaatatgatgcgtaacggtgcagattatgctgtattcatcaatacagcacaagaatttgatgggagtgattctggagctcatcctgatgaggctgtatcgtgggggaaaatacgaggttctgctaaaactgttaaggtccactgtgatgcaactattgcttttcctctcctagttgctgaaacatttgcccctaggaggaacagattctgcagcagtactcaaagctagggctgtgtgcagttcttggccagaaaattgattcatttttatttgtattatgactgaacgatccgcaggatgggtagtgggctccattgatgccataaacttctttttttttcccctcagaattaagggatccgccagaacacactgctctcagccccaaaccattgttgcctctactgggagtagcataaccaattgaattgcgctcctccaagcagcgcctcttagttgcgttatttattgtaagtagcgcaaccaactaaattatgctagttcccacatttattgactgctattttcaaaagaaaaaaaaaaaaaaaaa

SEQ ID NO: 46 - protein, 373 aa, Populus deltoides
MTGKKQWEEDLLSSVRTTVFKESEALDGKCIKIEGYDFNQGVNYSKLLKSMVSTGFQASNLGDAIQVVNNMLDWRLADEEITEDCSDEERELAYRESVRCKLFLGFTSNLVSSGVRDTIRYLVQHHMVDVVVTTAGGIEEDLIKCLAPTYKGDFSLPGAQLRSKGLNRIGNLLVPNDNYCKFEDWIIPIFDQMLKEQIEENITWTPSKLIARMGKEINNESSYLYWAYKNDIPVFCPGLTDGSLGDMLYFHSFHNPGLIVAIVQDIRAMNGEAVHASPRKTGIIILGGGLPKHHICNANMMRNGADYAVFINTAQEFDGSDSGAHPDEAVSWGKIRGSAKTVKVHCDATIAFPLLVAETFAPRRNRFCSSTQS

SEQ ID NO: 47 - DNA, 1532 bp, Phaseolus vulgaris
aactacaccgtctctgttgcgttgcgcgcagaggagagagagagagagaggagagagagaataatggaagaaacaaagagaaaggaagaagaagtgctagcatcagctcactccacggtgttcaaagaatcagaaagccttgatggaaagtgtgctaagattgaaggctatgatttcaaccatggcgttaactatccgctgctactcaggtccatggccaccactggctttcaggcttcgaatctcggtgatgccatccaagtagttaatcaaatgctagattggaggctagttgatgaagccgtgactgaggattgcagtgaccatgagagggacttggagtaccgaaaatctgtgacttctaaagtgtttctgggtttcacttctaatcttatttcctctggtgttagagacattgttcggtttcttcttcagcatcgcatggttgatgtagttgttacaactacaggtggcattgaagaagatcttataaagtgccttgcaccaacattttcaggagatttctctctgcctggagcgtatctacgctcgaaagggttgaatcggattggtaatttgttggtccctaatgataactattgcaaatttgaggactggattattcctattttcgatcagatgttaaaggaacaaaatactgagaatgtgttgtggacaccatctaagttaatagctcggttgggaaaagaaataaacaacgaaagctcttacctttactgggcgtacaagaacaacattccagttttctgtcctggcttaactgatggctcattgggggatatgctgtacttccattccttccgcaatcctggtctgattgtggacatagtgcaagatataagggcaatgaatggtgaagctgttcatgcaaatcccaggaagacgggaatgatcattttaggaggtggccttccaaaacatcacatttgcaatgccaatatgatgcgcaatggagcagactatgctgtttttatcaatactgcacaagaatatgatggtagtgattctggagctcgtcctgatgaggctgtttcgtgggggaaaatccgtggatctgctaaaactgtcaaggtgcactgtgatgcgacaatagcattccctctgctggttgctgaaacgtttgcttccagagttaaacctcaccattgatggaggctaaacacgaatttgttgtaaagtttgatttagttgtgttgtgatttgatgatcttgacgtttgagttcgctgtgggtgcttaacatggcaatcattttattcttctgctgtacgtggcagaggacatcattccaaaataatccactgatcctggcattgtggaagtcgggaactgtagatgtagtcataatttttcattggagatgattgtacaaactaatcttatgagtgctgatagttgacaaccctgcatcaaattaactgaaaagagaaatgatattttgttgaaatggaacaattttgaaattttattggttaaatcacagttgtaaactgatatcttatcactgtgcaa

SEQ ID NO: 48 - protein, 389 aa, Phaseolus vulgaris
NYTVSVALRAEERERERRERIMEETKRKEEEVLASAHSTVFKESESLDGKCAKIEGYDFNHGVNYPLLLRSMATTGFQASNLGDAIQVVNQMLDWRLVDEAVTEDCSDHERDLEYRKSVTSKVFLGFTSNLISSGVRDIVRFLLQHRMVDVVVTTTGGIEEDLIKCLAPTFSGDFSLPGAYLRSKGLNRIGNLLVPNDNYCKFEDWIIPIFDQMLKEQNTENVLWTPSKLIARLGKEINNESSYLYWAYKNNIPVFCPGLTDGSLGDMLYFHSFRNPGLIVDIVQDIRAMNGEAVHANPRKTGMIILGGGLPKHHICNANMMRNGADYAVFINTAQEYDGSDSGARPDEAVSWGKIRGSAKTVKVHCDATIAFPLLVAETFASRVKPHH

SEQ ID NO: 49 - DNA, 1740 bp, Cicer arietinum
ctggttcctttagatcgcgtgcgactcagagagagaacatactgaaaacagtgaacaacctcaaacgccgccgccgtaagataaaatagcaattcgaagcgaaggaaaaaggtaaagtattgaggtagtgtttgtgtattgaaaaagtcaacgataatgagtgagtcaaagcaagatgacatagttatggcatcagttcactccacagtcttcaaagaatcagaaagcctcgatggaacgtgtctccaaattaaaggttacgatttcaacaacggcgtcaattatcaacaacttctcaattccatgctcactactggatttcaagcttcaaaccttgctgatgccattaacgtcgttaatcaaatgctagattggaggctggttgatgaacctgtgactgaggattgtgctgacgaagagagagatttggattacagaaaatctgttaagtgtaaagtgtttttgggtttcacttctaatctcatttcatctggtgttagagatgttgttcgttacctttgtcagcatcacatggttgatgtgattgttacaactacaggtggtatcgaagaagatctcataaagtgccttgcacctacatataaaggagatttctctttgcctggagctcatcttcgctcaaaaggattgaatcgaattggtaatttattggtccctaatgacaattattgcaaattcgaggactggattattcctatttttgatcaaatgttgagggaacaaaataatgagaatgttctgtggacaccgtccaagctaatagctcgattgggaaaagaaattaacgacgaaagctcctacctttactgggcatacaagaataatattccagttttttgtcctggattaactgatggctcattgggtgacatgctgtacttccattccttccacaaccctggtctgattgtggacatagtgcgagatataagggctgtgaatggtgaagctgtacatgcaaatcctaggaagacaggcataattattttaggaggtggtcttccaaaacatcacatttgcaatgccaatatgatgcgcaatggggcagactatgcggtttttattaacactgctcaagaatttgatggaagtgattctggagctcgtccagatgaggctgtttcatgggggaaaatacgaggatcagctaaaactgttaaggtacattgtgatgcaacaatagctttccctcttctggttgctgaaacatttgcctcaaaaacgaaacgtcaccattgataaaggtttactgtcaaagttcatttgaaatgtattgtgtctgagggaaatggattttctccatttcttctctccagactccggtactaaagtttagtggtgattctgagtggataaattatatttggacttgcccaatgtcacaaggtaataattatattttcaaaactctagtagtagaagaaatggagaaaaagagaaatggagaggatccaatgttgtgtttgaggatcttgatggaccagtttgccattgacatttaattttatcatgttattcttaaggtctacttagcaggcatcttttaccattcaaacgggtaatggtcacgaattgtacatgtaaaatatgtaatgatattatttttggagatgtggtttcttagttttgaggcgttgaaaattgtaatatcttgaggaaataagactagataagtttatgaacttactgctcatttatagaattttcaatatttttcaa

SEQ ID NO: 50 - protein, 367 aa, Cicer arietinum
MSESKQDDIVMASVHSTVFKESESLDGTCLQIKGYDFNNGVNYQQLLNSMLTTGFQASNLADAINVVNQMLDWRLVDEPVTEDCADEERDLDYRKSVKCKVFLGFTSNLISSGVRDVVRYLCQHHMVDVIVTTTGGIEEDLIKCLAPTYKGDFSLPGAHLRSKGLNRIGNLLVPNDNYCKFEDWIIPIFDQMLREQNNENVLWTPSKLIARLGKEINDESSYLYWAYKNNIPVFCPGLTDGSLGDMLYFHSFHNPGLIVDIVRDIRAVNGEAVHANPRKTGIIILGGGLPKHHICNANMMRNGADYAVFINTAQEFDGSDSGARPDEAVSWGKIRGSAKTVKVHCDATIAFPLLVAETFASKTKRHH

SEQ ID NO: 51 - protein, 411 aa, Artificial Sequence
  Consensus sequence
  misc_feature (1)..(36): Xaa can be any naturally occurring amino acid
  misc_feature (38)..(38): Xaa can be any naturally occurring amino acid
  misc_feature (41)..(41): Xaa can be any naturally occurring amino acid
  misc_feature (52)..(52): Xaa can be any naturally occurring amino acid
  misc_feature (55)..(55): Xaa can be any naturally occurring amino acid
  MISC_FEATURE (59)..(59): Xaa can be either L, Q, I or V
  misc_feature (66)..(67): Xaa can be any naturally occurring amino acid
  misc_feature (72)..(73): Xaa can be any naturally occurring amino acid
  misc_feature (76)..(76): Xaa can be any naturally occurring amino acid
  misc_feature (79)..(79): Xaa can be any naturally occurring amino acid
  MISC_FEATURE (90)..(90): Xaa can be any of H, T, K, N, A, D, Q or E
  MISC_FEATURE (92)..(92): Xaa can be either L, Q, I or V
  MISC_FEATURE (93)..(93): Xaa can be any of H, T, K, N, A, D, Q or E
  MISC_FEATURE (94)..(95): Xaa can be either L, Q, I or V
  MISC_FEATURE (97)..(97): Xaa can be any of H, T, K, N, A, D, Q or E
  MISC_FEATURE (100)..(100): Xaa can be any of H, T, K, N, A, D, Q or E
  misc_feature (107)..(110): Xaa can be any naturally occurring amino acid
  MISC_FEATURE (111)..(111): Xaa can be any of H, T, K, N, A, D, Q or E
  MISC_FEATURE (117)..(117): Xaa can be any of H, T, K, N, A, D, Q or E
  misc_feature (118)..(118): Xaa can be any naturally occurring amino acid
  MISC_FEATURE (119)..(119): Xaa can be any of H, T, K, N, A, D, Q or E
  misc_feature (120)..(120): Xaa can be any naturally occurring amino acid
  MISC_FEATURE (121)..(121): Xaa can be either R, F or Y
  misc_feature (122)..(122): Xaa can be any naturally occurring amino acid
  misc_feature (124)..(124): Xaa can be any naturally occurring amino acid
  misc_feature (127)..(127): Xaa can be any naturally occurring amino acid
  MISC_FEATURE (130)..(130): Xaa can be either L, Q, I or V
  MISC_FEATURE (139)..(139): Xaa can be either L, Q, I or V
  MISC_FEATURE (143)..(143): Xaa can be either L, Q, I or V
  MISC_FEATURE (145)..(145): Xaa can be any of H, T, K, N, A, D, Q or E
  MISC_FEATURE (147)..(147): Xaa can be either L, Q, I or V
  MISC_FEATURE (149)..(149): Xaa can be either R, F or Y
  MISC_FEATURE (166)..(166): Xaa can be either L, Q, I or V
  MISC_FEATURE (178)..(178): Xaa can be either R, F or Y
  MISC_FEATURE (181)..(181): Xaa can be any of H, T, K, N, A, D, Q or E
  misc_feature (188)..(188): Xaa can be any naturally occurring amino acid
  MISC_FEATURE (205)..(205): Xaa can be any of H, T, K, N, A, D, Q or E
  MISC_FEATURE (212)..(212): Xaa can be any of H, T, K, N, A, D, Q or E
  misc_feature (223)..(223): Xaa can be any naturally occurring amino acid
  misc_feature (226)..(227): Xaa can be any naturally occurring amino acid
  MISC_FEATURE (230)..(230): Xaa can be either L, Q, I or V
  misc_feature (231)..(231): Xaa can be any naturally occurring amino acid
  MISC_FEATURE (247)..(247): Xaa can be any of H, T, K, N, A, D, Q or E
  MISC_FEATURE (263)..(263): Xaa can be either R, F or Y
  MISC_FEATURE (277)..(277): Xaa can be either R, F or Y
  misc_feature (283)..(291): Xaa can be any naturally occurring amino acid
  MISC_FEATURE (296)..(297): Xaa can be either L, Q, I or V
  MISC_FEATURE (299)..(299): Xaa can be either L, Q, I or V
  MISC_FEATURE (303)..(303): Xaa can be either L, Q, I or V
  MISC_FEATURE (311)..(311): Xaa can be either L, Q, I or V
  misc_feature (314)..(314): Xaa can be any naturally occurring amino acid
  MISC_FEATURE (322)..(322): Xaa can be either L, Q, I or V
  MISC_FEATURE (347)..(347): Xaa can be either R, F or Y
  MISC_FEATURE (348)..(348): Xaa can be either L, Q, I or V
  MISC_FEATURE (354)..(354): Xaa can be either R, F or Y
  misc_feature (399)..(399): Xaa can be any naturally occurring amino acid
  misc_feature (401)..(411): Xaa can be any naturally occurring amino acid
XXXXXXXXXXXXXXXXXXXXXXXXXXXXXXXXXXXXLXSVXSTVFKESESLXEGXCTKXEGYDFNXXGVNYXXLLXSMXTTGFQASNLGXAXXXXNXMLXWRLSDEXXXXXDCSEEXXXXXXRXSVXCKXFLGFTSNLXSSGXRXTXRXLVQHHMVDVIVTTAGGXEEDLIKCLAPTXKGXFSLPGAXLRSKGLNRIGNLLVPNXNYCKFEXWIIPIFDQMLXEQXXENXXWTPSKLIARLGKEINXESSYLYWAYKNNIPVXCPGLTDGSLGDMLXFHSFRXXXXXXXXXNPGLXXDXVQDXRAMNGEAXHAXPRKTGMIXLGGGLPKHHICNANMMRNGADYAVXXNTAQEXDGSDSGARPDEAVSWGKIRGSAKTVKVHCDATIAFPLLVAETFAXKXXXXXXXXXXX

SEQ ID NO: 52 - protein, 362 aa, Vitis vinifera
MEENFLSSVRSVVFKESNSLEGVRTKIEGYDFNAGVDYSQLLKSMVSTGFQASNLGDAIQVVNQMLDWRLSDESPAEDCSEEERDEKYRKSVKCKVFLGFTSNLISSGVRDTVRYLTEHHMVDVVVTTAGGIEEDLIKCLAPTYKGDFYLSGTHLRSKGLNRIGNLLVPNDNYCKFEDWIIPIFDQMLKEQTSENVLWTPSKVIARLGKEINNESSYLYWAYKNNIPVFCPGLTDGSLGDMLYFHSFRNPGLIIDIVQDIRAMNGEAVHANPRKTGMIILGGGMPKHHICNANMMRNGADYAVFINTAQEFDGSDSGARPDEAVSWGKIRGSAMTVKVHCDATIAFPLLVAETFAAKISKPL

SEQ ID NO: 53 - protein, 307 aa, Theobroma cacao
MEDKLMNSVHSTVFKESDSLEGKCTKIEGYDFNQGVNYSQLLKSMLSTGFQASNLGEAMEIVNEMLDWRLADEAITEDCSEEEKDPAYRESVRCKVFLGFTSNLISSGLRDTVRYLTEHHMVDVIVTTTGGIEEDLIKCLAPTYKGDFYLPGAQLRSRGLNRIGNLLVPNDNYCKFEDWIIPIFDQMLKEQLEENEIPVFCPGLTDGSLGDMLYFHSFHSPGLIIDVVQDIRAMNSEAVHASPRKTGMIILGGGLPKHHICNANMMRNGADYAVYINTAQEFDGSDSGARPDEAISWGKIRGSARTV

SEQ ID NO: 54 - protein, 387 aa, Camellia sinensis
MGEEDMEERLLDSVRSVVFKESETLEGSCIKIQGYDFNRGVNYSELLKSMVSTGFQATNLGDAIEVVNQMLDWRLSYESLTEDCGEEERNPAYRESMRCKVFLGFTSNLISSGVRDTIRYLVQHHMVDVVVTTAGGVEEDLIKCLAPTYKGDFSLPGAHLRSKGLNRIGNLLVPNENYCKFEDWIIPIFDQMLEEQTAKNVLWTPSKVIARLGKEINNESSYLYWAYKNNIPVFCPGLTDGSLGDMLYFHSFRNPGLVVDVVQVYDNLGNELMTLALYIDIRAMNGEAVHASPRKTGMIILGGGLPKHHICNANMMRNGADYAVFINTAQEFDGSDSGARPDEAVSWGKIRGSAKTVKVHCDATIAFPLLVAETFAARGKRSAENES

SEQ ID NO: 55 - protein, 289 aa, Mentha longifolia
MGDATRYTLPEAVRSTVFKASESLEGASAKIEGYDFNKGVDYPELLKSMAVTGFQASNLGDAIHLVNEMLDWRLSDETPAEDCSQEERDPAHRDSVRCKVFLGFTSNLISSGIRDIIRFLVQHRMVDVVVTTAGGVEEDLVKCLAPTYRGDFSLPGAVLRSKGLNRIGNLLVPNDNYCKFEDWIIPVFDQMLDEQNSQNVLWTPSKLIACLGKEINDETSYLYWAYKNNIPVFCPGLTDGSLGDMLYFHSFKNPGLVVDIVQDIRAMNGEAVHAGQRKTGMIILGGGLP

SEQ ID NO: 56 - protein, 364 aa, Coffea canephora
MGDALNGGNPLESARLAAFKQSETLEGTCPVIQGYDFNQGVNYPELLKSMVSTGFQASNLGDAIDVVNQMLDWRLSDECPTEDCSEEERDPAFRESVRCKVFLGFTSNLVSSGVRDTIRYLVQHHMVDVVVTTAGGVEEDLIKCLAPTYKGDFSLPGAALRSKGLNRIGNLLVPNNNYCKFEDWIIPIFDKMLEEQTSKNMLWTPSKVISRLGKEINDESSYLYWAYKNNIPVFCPGLTDGSLGDMLYFHSFRNPGLVIDIVQDIRNMNGEAVHVGLRKTGMIILGGGLPKHHICNANMMRNGADFAVFINTAQEYDGSDSGARPDEAVSWGKIRGSAKAVKVHCDATIAFPLLVAETFATKVK

SEQ ID NO: 57 - protein, 362 aa, Guillardia theta
MSESTSKAEEAVLIQSVPMPAGSVKVRGYDFNEGLDYDRLLGSFLSSGFQATNFGLAVEEVNKMRQWRLSDEPVAEDEDEELKSIEARSKVKSTIFLGYTSNMASCGVRETIRYLCQHKMVDVVVATAGGVEEDFIKCLAPTYIGSNGFDLDGKTLRKQGLNRIGNMLVPNENYCRFEEWLMPILDKMLDEQLATGEPWTPSKFIKRLGLEINNPESIYYWCAKNDIPVFSPALTDGSIGDMLFFHSYKRTGLVLDLVGDIREINMKAMKARHTGAIIIGGGVVKHHIMNANLMRNGCDHAVLINTGQEYDGSDSGAKPDEAISWGKIKMNVTPIKIYAEATIVFPLLVAQTFAKDGPREKV

SEQ ID NO: 58 - DNA, 1089 bp, Vitis vinifera
atggaagagaatttcctatcatctgtacgatcggtagtcttcaaagaatcaaattccctggaaggggtacgcactaagatcgagggctatgatttcaatgcaggcgttgattattctcagcttctcaaatccatggtctccaccggcttccaagcctccaatctcggcgacgccatccaagtcgttaatcaaatgctagactggaggctttctgatgagagtccggcggaggattgcagcgaggaggagagggatgaaaagtatagaaaatcggtgaagtgcaaagtgtttctgggtttcacttccaatctgatttcgtcgggtgtgagagatacagtgcgatatcttactgagcatcatatggttgatgtggtggttacaacagctggtggcatagaagaggatcttattaaatgccttgcacccacatacaaaggtgatttttatctatccggtactcatttacgctcaaaaggattgaaccgcattggtaacttgttggttcccaatgacaactactgcaaatttgaggattggattattccgatctttgaccagatgttgaaggagcaaacttcggagaatgtattgtggacaccttctaaggtaattgctcgcttgggaaaagaaatcaataatgagagttcatacctttattgggcatacaagaacaatattccagtcttctgcccgggtttaaccgatggctcattaggggacatgttatacttccattccttccgcaatcctggtctgatcattgacatagtgcaagatattagggccatgaatggtgaagctgtccatgcaaatcctagaaagactggaatgataattcttggagggggcatgcccaagcatcacatttgtaatgccaatatgatgcgtaatggtgctgattatgctgtcttcatcaacacagcacaagagtttgatggaagtgattctggagctcgccctgatgaggctgtgtcatgggggaaaatacggggttctgccatgactgttaaggtacattgtgatgcaactattgcttttccccttctggttgcagaaacatttgctgcaaagataagcaagcctctctga

SEQ ID NO: 59 - DNA, 1552 bp, Theobroma cacao
atgtcattggcaaagtcactaattttaagaaaaaaatttgagaataagaaaataagttgaattgaatttttagcctttgaatttggtgtcaaagtttaaacattttcccatgaaaaagaacttagctttccaaatcaataatcaaattaattagcaaaaaaaataaatcccaaattaaaacaagcagcataaaattatcaaatttcaaaattttttgaaaaaataaaacattataatgacctttttgtgcttcttttcccaatttcatttaaataaaagaaaaaagaaacaaggaacataacaagaaagaatcttgccgcaagctgcgtactgtaaaaccctctcaactctccgtcggtctctccacgccgcctaaagaaggctgctttctgtctttcggacccgaagctcttaaacccggtttgactctctcctttttctctctctacgtttcttagaaattactaacaaagctgaagattactgtcttagtctcgctctcggattgctttgtatttgtttcatgaatgctttttgcctgcaaaagaatttgcaaattaactacattctctgtctctgcttaaacttgggtttcctggccaagaacaaaagaagaaaagggagatatggaggataagctcatgaactctgtacactccaccgtttttaaagagtcagattcccttgaggggaagtgtacaaaaattgagggttatgacttcaatcagggtgtaaactactcccagcttctcaagtccatgctttccactggatttcaagcttccaatcttggagaagctatggaaattgtcaatgagatgctagactggaggcttgctgatgaggctataactgaggactgcagtgaggaggagaaggatcctgcctacagagaatctgtcagatgcaaggtctttttgggttttacatcaaatcttatttcatctggtcttcgagatactgttcgttatcttactgagcatcacatggttgatgtaatagttactacaactggtggcatagaagaagatctcataaagtgccttgcaccaacatataaaggtgatttttatctacctggtgctcagttgcgttcaagaggattgaatcgcattggtaacttgttggttcctaatgacaactactgcaaatttgaggattggatcattccaatttttgatcagatgttgaaggaacaacttgaagagaacgagattcctgtcttctgtccaggcttaacagatggctctttgggggatatgttgtattttcattcctttcacagcccaggtctgataattgatgtagtgcaagatattagggccatgaatagtgaagcagtccatgcaagtcccaggaaaacaggaatgataattctaggaggtggactgccaaagcatcatatctgcaatgctaatatgatgcgtaatggtgctgattatgctgtttacataaatacagcacaagagtttgatgggagtgattctggagcccgccctgatgaggctatttcatgggggaaaatacgaggttctgctagaacggttaagtc

SEQ ID NO: 60 - DNA, 1164 bp, Camellia sinensis
atgggggaagaagacatggaagaacgtcttttggattccgtacgctcagtagttttcaaagaatcagagactctcgaaggatcttgtattaagatccaaggctatgatttcaaccgaggcgtcaactattctgagcttcttaaatccatggtctcaactgggtttcaagccaccaatctcggcgatgccattgaagttgtcaatcaaatgctagactggaggctttcctacgagtctttgacggaggactgcggcgaagaggagagaaacccggcatacagagagtccatgaggtgcaaggtttttctgggttttacatccaatttgatttcttctggtgttcgagacaccattcgctatcttgttcagcatcacatggttgatgtagttgttacaacagctggtggtgttgaagaagaccttataaaatgcctcgcaccgacatataaaggcgatttttctttacctggagctcatttacgttcaaaaggattgaaccgcattggtaacttgttggttcccaatgagaactactgcaaatttgaggattggatcattccaatatttgaccagatgttggaagagcagactgcgaagaatgtattgtggactccatctaaagttattgctcgcttagggaaagaaataaacaatgagagttcatacctctactgggcatacaagaacaatattccagtcttctgccctggcttaactgacggctctttgggggatatgttatactttcattctttccgcaaccccggtctagtcgttgacgtagtgcaagtatacgataacttaggaaatgaattgatgaccttagctctatacatagatattagggccatgaatggtgaagctgtccatgcaagtcctaggaagactggaatgataattcttggaggtggacttcccaagcatcacatttgcaatgcgaatatgatgcgtaacggggcagattatgcagtctttattaacacagcgcaagagtttgatggtagtgattctggtgctcgtcctgatgaagctgtatcatggggaaaaatacgaggttctgctaagactgttaaggtacattgcgatgcgactattgcttttcctctactggttgcggaaacatttgctgcaaggggaaagagatcggccgagaacgagtcctaa

SEQ ID NO: 61 - DNA, 958 bp, Mentha longifolia
ttttttttacaagggaattagttgctttcgaataacgctgaaactaaacgctctgaacaccgtccgccaccgccgccgccgccgccgccatgggagatgctacgaggtacactctgcctgaggccgtacgatcaacagtgttcaaggcgtccgagtcgttggaaggcgcctccgccaaaatcgagggctacgatttcaacaagggcgtcgactaccccgagctgctcaagtccatggccgtcaccggattccaggcctccaatctaggcgacgccatccacctagttaacgaaatgctagattggaggctttcggatgagactccggcagaggattgcagccaagaggagagagatcctgctcatagagactctgtgaggtgcaaagtgtttcttggttttacttccaatctgatttcttcgggaattcgagatataatccgctttctcgtccagcatcgcatggttgatgttgtggtaaccacagcaggtggtgtggaggaggaccttgttaagtgtcttgcaccgacttatagaggtgacttttctctgcctggagctgttctacgctcaaagggtctgaaccgcattggtaatttgttggttcctaatgacaattactgtaaatttgaggattggatcatccctgtttttgatcagatgttagatgagcaaaattctcagaatgtactgtggacgccatccaaattaattgcatgcctggggaaagaaatcaatgatgagacttcatacctttactgggcatataagaacaatatccctgttttctgccctggcttaacagatggttcactgggtgacatgttgtacttccactctttcaagaatcccggtttagtggttgacatcgtccaagatattagggcgatgaacggtgaagctgttcatgctgggcaaaggaaaactgggatgataatacttggaggagggctcccaaa

SEQ ID NO: 62 - DNA, 229 bp, Coffea canephora
catgaacggcgaggctgtccatgtcggtctcaggaagacaggaatgataattcttggagggggactacccaagcatcatatatgtaatgcaaatatgatgcgtaatggtgcagactttgctgtttttattaacacagcacaagaatacgatggaagtgattctggtgcccgtccagatgaagctgtatcatggggaaagatacgaggttctgcgaaggctgtgaaggtt

SEQ ID NO: 63 - DNA, 1089 bp, Guillardia theta
atgtcggagagcaccagcaaggccgaagaagcagtcttgatccagtcagtgccgatgcctgctggctcggtgaaagtgaggggatacgacttcaacgagggtctcgactacgatcgtctccttggaagctttctgagcagtggtttccaagcgaccaacttcgggctggcggtcgaggaggtcaataagatgcgccaatggcgcctcagcgacgagcctgttgctgaggacgaggacgaggaactgaagagtatcgaggcgagaagcaaggtcaagtcaactatcttcttggggtacacgagcaacatggcgtcttgcggagtgagggagacgatccgatatctgtgccaacacaagatggtcgacgtggtggttgccactgctggaggggtagaggaggatttcatcaaatgcctggccccgacgtacatcggaagcaacgggtttgacctcgacggcaagaccctgaggaagcaaggtctgaacaggatcggcaacatgctggtacccaacgagaactactgtcgcttcgaggaatggttgatgcccattctcgacaagatgctcgatgagcagctcgcaaccggagagccctggactccttccaagttcatcaagagactgggactggaaatcaacaaccctgagagcatctactactggtgcgccaagaacgatatccccgtgtttagtccggctctcaccgacgggtccattggcgacatgctcttcttccattcttacaagcgaactggactcgtgctggatctagttggcgacatccgcgagatcaacatgaaggcgatgaaagcaaggcacacgggtgcaatcatcatcggtggaggcgtcgtaaagcatcacatcatgaacgcaaatttaatgcgaaatggatgcgaccatgctgtcctgatcaacacaggtcaggagtacgacggcagcgacagcggcgcaaagccggacgaggcgatttcatggggaaagattaagatgaacgtgacgcctatcaagatctacgcagaggccaccatcgtgttccccctgctagtggcgcagacgttcgcgaaagatggcccacgcgagaaagtttga

SEQ ID NO: 64 - protein, 376 aa, Lactuca sativa
MGEVVKEAGVIENLRSVVFKESESLEGSCAKIQGYDFNTGINYSQILKSLISTGFQASNLGDAIETVNQMLDWRLSHEQVTEDCSEEESNPAYRESVKCKIFLGFTSNLISSGVRDIIRYLTQHHMVDVIVTTTGGIEEDLIKKCLADTYRGEFSLPGAALRSKGLNRIGNLLVPNDNYCKFEDWIIPIFDQMLQEQNTQHVLWTPSKVISRLGKEINNESSYLYWAYKNDIPVFCPGLTDGSLGDMLYFHSFRNPGLVIDVDIRAINSEAVHANPRKTGMIILGGGLPKHHICNANMMRNGADYAVFINTAQEFDGSDSGARPDEAVSWGKIRGSAKSVKVHCDATIAFPLLVAETFAAKREGEMKNVESTKALV

SEQ ID NO: 65 - DNA, 1134 bp, Lactuca sativa
atgggggaagtcgttaaagaggcaggggtgattgagaacttaaggtcggtggtgttcaaggaatcagagagtttagaaggcagctgtgctaaaatccagggctacgatttcaacactgggattaattattcgcagattctcaaatccctaatttccactggattccaagcttctaacctcggtgatgccattgaaaccgttaatcaaatgctagactggaggctttctcatgagcaagtaaccgaagattgcagtgaggaagagagtaatccagcttacagagagtctgtcaagtgcaaaatctttctagggttcacttcaaacctcatttcttctggtgttcgagacattattcgctatctaactcaacatcatatggttgatgtgattgtgacgacaaccggtggcattgaggaagatctgataaaatgtcttgcagacacatacagaggtgaattttctctacctggtgctgccttaaggtcaaaaggtcttaatcgtattggtaacttattggtgccaaatgataactactgtaaatttgaggattggattatcccaatattcgaccaaatgcttcaagaacaaaatacacagcatgtgttatggactccatcaaaagtaatatcacgtttggggaaggagattaataatgagagttcttatttatattgggcatataagaacgacattcctgtgttttgcccaggcttaacagacgggtctctaggggacatgttatatttccattcatttcgcaatccgggtcttgttattgatgtagtacaagatatacgcgcgattaacagcgaggctgtgcatgcaaaccctagaaagacagggatgataattctaggaggagggttaccaaaacatcacatttgtaatgcgaatatgatgagaaatggtgcggattatgctgttttcatcaacactgctcaggagtttgatggcagtgattctggtgctcgacctgatgaagctgtctcctgggggaaaatacgtggttctgctaaatctgtcaaggtgcactgtgatgcaactatcgcgttccctttacttgttgcagaaacatttgctgcaaagagagagggggagatgaaaaatgttgagtcaaccaaagctttggtttaa

SEQ ID NO: 66 - DNA, 3403 bp, Arachis duranensis
aatgacaatccctaaaaccaaaaacactgaaaagtgaaaacacatcatattccactctctgccgccggcaccgcgacgattatcacctctttcagaagctcaggtaggtgcttaagctttcactcttcatctgttctctgtctctttttttttatatattttgtgtgttttagtttagataaatattccttccgtctttatctgtgaattgagttttgttgttataaaacttcatcccagtatcatagcacgtttgtgctcctcgtactgtgttgcaatttttagaggaacttctcagctcgatgggtgaggcaaaggaagataatgttgttctatcttcagttcactccacagtcttcaaagaatccgaaaatctagaaggaaaatgcaccaaaattgaaggctatgacttcaaccaaggcgtcaattaccatcagcttctcaagtccatggtcaccactggctttcaagcttcaaacctaggagacgcaatccaagtcattaatcaaatggtttgttttgtttgcttttctttgtgccccccatctgtttgtttttgtgactttttgctcataaagttattgtctttgcaacttttggggaactgggttgaagctagattggaggctcgctgatgaacctgtagtcgatgattgcagtgaggaagagagggatttgggttaccgaaggtctgttacttgcaaggtgtttctgggattcacttctaatctcatctcctctggtgtcagagacactgttcggtttctcgttcaacatcacatggtgagtatcctgtaagcgtaaattgggaagttggttccccttaatttctgttaacatgataaatgtttggttttcggttgtatctggaaaaatatctgttttagtgtgttgtttgtggtgtcataaaatgattgtaagatggaagaattgaaaaaacttttgtagctggtgcatatataatgtatatagtatctctagttcactaccaagtattttgtagcatagcatcgtgtaagtagagactttgttgttagattgttcatcaatagggtgacaagcatcacattgactgattgttgctaatccccttgattagagataaaattaaatttaactgattgtctttgaacaatgatagagtgtgtacttgttgaattccaaaagtaatttgcaaaaggaagtgttttttttttcctttggaaaaataaattaaattcaaattgtgatagtattataattcttgatctgttacaggttgatgtaattgtgacaactactggtggcatcgaggaagatcttataaagtgccttgcaccaacatacaaaggagatttctctctggatggagcctatctgcgctcaaagggattgaatcgtattggtaatttgttggtccctaatgacaattattgcaaatttgaggactggattattcccatttttgatcagatgttgacagaacaaaataatgaggtactttattttatagctgtcatgtagtgtgtgaaagtttttgtggatgcatggggacttatttaccatctgtctttgttttcctttttcaatattagtgtcgtctgtatttgtattatactattctgtatatgttttgtttatggtaagttgctaacaaaattaactaaaatagatttaacattttaaaattgaatggcatacctctgatgaagcaggtgctacttgaaacttgtttttcccgacacttgttcatcttactcttttttcttcttcctttttgacagaatgtgatatggacaccatccaagttgattgctcgattgggtaaagaaataaagaatgaaagctcttacctttattgggcatacaaggtaaggctgtgggagcaaagctttttttataatcatgttattccctgcattttgttcctgattcaagtcttcgcctatttccttttctgagcattaggttattgtttctctatatttcttgtatcatgtatgtatacgatgaaatgtagttattgtgtaaatttcctgactttctaaacagcgttgatttagaaaatcacaattattgttgagtttctttcatattttccagaacaatattccagtattttgtccgggcttaaccgatggctcattgggggacatgctgtacttccattcgttccgcaacccgggtctgattgtagacatagtgcaaggtcttttctactctcttttgccttcctacttcctgagtgaatctgaattgtgtagaatgacaactttgccatgtaacagatataagggccatgaatggagaagctgtacatgcgagtcctaggaagaccggcatgattattttaggaggtggtcttccaaagcatcacatctgcaatgccaatatgatgcgtaatggtgcagactacgctgtttttattaataccgcacaagaatttgatggtagtgattcgggagctcgtccagatgaagctgtttcctggggaaaaatacgaggatctgcaaaaactgttaaggtacatcctctatatgatttcacaattacttttcttcttgtcagaattctctaaattgctgcggtgaatgctatggctatagtttcatacttttggattattgtagccagctaatatcatcaatcatcatcctgatttagaatatgactgaaaattccaaggttcatccaattttatattataaaatacaaccatgatttctactaacattagcagaattgcaaaatatgctgatgtccattgttgttcttatatttgttggacttctaaagatttatgtaacgttagtcatgaataaatattttgtcttaatctctatgcttacaagtatgttgatttcattaaaccaggtccattgtgatgcaaccatcgccttccctttgcttgttgccgaaacatttgccccaagagtgaaaccttgcaatcaatagaggttaagacaaactaactgtcaagttcgcgtaaatttcattgtttgaggacattgatgaacgtgttcaccgttggtatttgattaggtcatcatgcctggtgtgtccatcattatcgtgtgcattttatgttataccaaaaaagaaaaagtaatacactaatcctgactgcatcagagacaggaattatagatgcaataaccaattttcattggtttatgtgagttttgggatgaggatgattgtaacttctaaaacaaataacattagaaacttgaaacttcatcaactttggaagtcggtatatttttatctttcttccaactgatggccaaatttcatgttggaggaaaagatatatcacaattcagaccttatttattcttctgaatcatattgctgtgcctgtacttgtgttcttgattgtatatatggttctgaatcaaatataatgacacaatggtatttt

SEQ ID NO: 67 - DNA, 103 bp, Arachis duranensis
  misc_feature: exon 1
aatgacaatccctaaaaccaaaaacactgaaaagtgaaaacacatcatattccactctctgccgccggcaccgcgacgattatcacctctttcagaagctcag

SEQ ID NO: 68 - DNA, 182 bp, Arachis duranensis
  misc_feature: intron 1
gtaggtgcttaagctttcactcttcatctgttctctgtctctttttttttatatattttgtgtgttttagtttagataaatattccttccgtctttatctgtgaattgagttttgttgttataaaacttcatcccagtatcatagcacgtttgtgctcctcgtactgtgttgcaatttttag

SEQ ID NO: 69 - DNA, 227 bp, Arachis duranensis
  misc_feature: exon 2
aggaacttctcagctcgatgggtgaggcaaaggaagataatgttgttctatcttcagttcactccacagtcttcaaagaatccgaaaatctagaaggaaaatgcaccaaaattgaaggctatgacttcaaccaaggcgtcaattaccatcagcttctcaagtccatggtcaccactggctttcaagcttcaaacctaggagacgcaatccaagtcattaatcaaatg

SEQ ID NO: 70 - DNA, 103 bp, Arachis duranensis
  misc_feature: intron 2
gtttgttttgtttgcttttctttgtgccccccatctgtttgtttttgtgactttttgctcataaagttattgtctttgcaacttttggggaactgggttgaag

SEQ ID NO: 71 - DNA, 168 bp, Arachis duranensis
  misc_feature: exon 3
ctagattggaggctcgctgatgaacctgtagtcgatgattgcagtgaggaagagagggatttgggttaccgaaggtctgttacttgcaaggtgtttctgggattcacttctaatctcatctcctctggtgtcagagacactgttcggtttctcgttcaacatcacatg

SEQ ID NO: 72 - DNA, 474 bp, Arachis duranensis
  misc_feature: intron 3
gtgagtatcctgtaagcgtaaattgggaagttggttccccttaatttctgttaacatgataaatgtttggttttcggttgtatctggaaaaatatctgttttagtgtgttgtttgtggtgtcataaaatgattgtaagatggaagaattgaaaaaacttttgtagctggtgcatatataatgtatatagtatctctagttcactaccaagtattttgtagcatagcatcgtgtaagtagagactttgttgttagattgttcatcaatagggtgacaagcatcacattgactgattgttgctaatccccttgattagagataaaattaaatttaactgattgtctttgaacaatgatagagtgtgtacttgttgaattccaaaagtaatttgcaaaaggaagtgttttttttttcctttggaaaaataaattaaattcaaattgtgatagtattataattcttgatctgttacag

SEQ ID NO: 73 - DNA, 219 bp, Arachis duranensis
  misc_feature: exon 4
gttgatgtaattgtgacaactactggtggcatcgaggaagatcttataaagtgccttgcaccaacatacaaaggagatttctctctggatggagcctatctgcgctcaaagggattgaatcgtattggtaatttgttggtccctaatgacaattattgcaaatttgaggactggattattcccatttttgatcagatgttgacagaacaaaataatgag

SEQ ID NO: 74 - DNA, 287 bp, Arachis duranensis
  misc_feature: intron 4
gtactttattttatagctgtcatgtagtgtgtgaaagtttttgtggatgcatggggacttatttaccatctgtctttgttttcctttttcaatattagtgtcgtctgtatttgtattatactattctgtatatgttttgtttatggtaagttgctaacaaaattaactaaaatagatttaacattttaaaattgaatggcatacctctgatgaagcaggtgctacttgaaacttgtttttcccgacacttgttcatcttactcttttttcttcttcctttttgacag

SEQ ID NO: 75 - DNA, 87 bp, Arachis duranensis
  misc_feature: exon 5
aatgtgatatggacaccatccaagttgattgctcgattgggtaaagaaataaagaatgaaagctcttacctttattgggcatacaag

SEQ ID NO: 76 - DNA, 232 bp, Arachis duranensis
  misc_feature: intron 5
gtaaggctgtgggagcaaagctttttttataatcatgttattccctgcattttgttcctgattcaagtcttcgcctatttccttttctgagcattaggttattgtttctctatatttcttgtatcatgtatgtatacgatgaaatgtagttattgtgtaaatttcctgactttctaaacagcgttgatttagaaaatcacaattattgttgagtttctttcatattttccag

SEQ ID NO: 77 - DNA, 106 bp, Arachis duranensis
  misc_feature: exon 6
aacaatattccagtattttgtccgggcttaaccgatggctcattgggggacatgctgtacttccattcgttccgcaacccgggtctgattgtagacatagtgcaag

SEQ ID NO: 78 - DNA, 79 bp, Arachis duranensis
  misc_feature: intron 6
gtcttttctactctcttttgccttcctacttcctgagtgaatctgaattgtgtagaatgacaactttgccatgtaacag

SEQ ID NO: 79 - DNA, 236 bp, Arachis duranensis
  misc_feature: exon 7
atataagggccatgaatggagaagctgtacatgcgagtcctaggaagaccggcatgattattttaggaggtggtcttccaaagcatcacatctgcaatgccaatatgatgcgtaatggtgcagactacgctgtttttattaataccgcacaagaatttgatggtagtgattcgggagctcgtccagatgaagctgtttcctggggaaaaatacgaggatctgcaaaaactgttaag

SEQ ID NO: 80 - DNA, 350 bp, Arachis duranensis
  misc_feature: intron 7
gtacatcctctatatgatttcacaattacttttcttcttgtcagaattctctaaattgctgcggtgaatgctatggctatagtttcatacttttggattattgtagccagctaatatcatcaatcatcatcctgatttagaatatgactgaaaattccaaggttcatccaattttatattataaaatacaaccatgatttctactaacattagcagaattgcaaaatatgctgatgtccattgttgttcttatatttgttggacttctaaagatttatgtaacgttagtcatgaataaatattttgtcttaatctctatgcttacaagtatgttgatttcattaaaccag

SEQ ID NO: 81 - DNA, 550 bp, Arachis duranensis
  misc_feature: exon 8
gtccattgtgatgcaaccatcgccttccctttgcttgttgccgaaacatttgccccaagagtgaaaccttgcaatcaatagaggttaagacaaactaactgtcaagttcgcgtaaatttcattgtttgaggacattgatgaacgtgttcaccgttggtatttgattaggtcatcatgcctggtgtgtccatcattatcgtgtgcattttatgttataccaaaaaagaaaaagtaatacactaatcctgactgcatcagagacaggaattatagatgcaataaccaattttcattggtttatgtgagttttgggatgaggatgattgtaacttctaaaacaaataacattagaaacttgaaacttcatcaactttggaagtcggtatatttttatctttcttccaactgatggccaaatttcatgttggaggaaaagatatatcacaattcagaccttatttattcttctgaatcatattgctgtgcctgtacttgtgttcttgattgtatatatggttctgaatcaaatataatgacacaatggtatttt

SEQ ID NO: 82 - DNA, 3207 bp, Arachis ipaensis
aatcacaatccctaaaaccaaaaacactgaaaagtgaaaacacatcatattccactctctgccgccggcaccgcgacgattatcacctctttcagaagctcaggtaggtgcttaagctttcactcttcatctgttgtattttagtttagataaatattccttctgtcttcatctgtgaattgagttttgttgttataaaactttatcccagtatcatagcacgtttgtgctcctcgtactgtgttgcaattttcacaagaacttctcagcttgggattcagctcgatgggtgaggcaaaggaagataatgttgttctatcttcagttcactccacagtcttcaaagaatccgaaaatctagaaggaaaatgcaccaaaattgaaggctatgacttcaaccaaggcgtcaattatcatcagcttctcaagtccatggtcaccactggctttcaagcttcaaacctaggagacgcaatccaagtcattaatcaaatggtttgttttgtttgcttttctttgtgccccccatctgtttgtttttgtgactttttgctcataaagttattgtctttgcaacttttggggaactgggttgaagctagattggaggctcgctgatgaaccagtagtcgatgattgcagtgaggaagagagggatttgggttaccgaaggtctgttacgtgcaaggtgtttctgggattcacttctaatctcatctcctctggtgttagagacactgttcggtttctcgttcaacatcacatggtgagtatcctgtaagcgtaaattgggaagttggttccccttaatttgtgttaacatgataaatgtttggttttcggttgtatctggaaaaatatctgttttagtgtgttgtttgtagtgtcataaaatgattgtaagatggaagaattgaaaaaacttttgtagctggtgcatataatgtatatagtatctctagttcactaccaagtattttgtagcatagcatcgtgaaagtagagactttgttgttagattgttcatcaatagggtgacaagcatcacattgactgattgttgctaatccccttgattagagataaatttaaatttaactgattgcctttgaacaatgatagagtgtgtacttgttgaattccaaaagtaattttcaaaaggaagtgtttttttttcctttggaaaaataaattaaattcaaattgtgatagtattataattcttgatctgttacaggttgatgtaattgtgacaactactggcggcattgaggaagatcttataaagtgccttgcaccaacatacaaaggagatttctctctggatggagcctatctgcgctcaaagggattgaatcgtattggtaatttgttggtccctaatgacaattattgcaaatttgaggactggattattcccatttttgatcagatgttgacagaacaaaataatgaggtactttattttatagctgtcttgtagtgtgtgtaagtttttgtggatgcatggggacttatttaccatctgtctttgttttcctttttcaatattagtgtcgtctgtatttgtattatactattctgtatatgttttgtttatggtaagttgctaacaaaattaactaaaatagattaacattttaaaattgaatggcatacctctgatgaagcaggtgctacttgaaacttgtttttcccgacacttgttcatcttactcttttttcttcttcctttttgacagaatgtgatatggacaccatccaagttgattgctcgattgggtaaagaaataaagaatgaaagctcttacctttattgggcatacaaggtaaggctgtgggagcaaaggtttttttataatcatgttattccctgcattttgttcctgattcaagtcttcgcctagttccttttccgagcattaggttattgtttctctatatttcttgtatcatgtatgtatacgatgaaacgtagttattgtgtaaatttcctgattttctaaacagcattgatttagaaaatcacaattattgttgagtttctttcatgttttccagaacaatattccagtattttgtccgggcttaaccgatggctcattgggggacatgctgtacttccattcgttccgcaacccgggtctgattgtagacatagtgcaaggtcttttctactctcttttgccttcctacttcctgagtgaatctgaattgtgtagaatgacaacttttcaatgtaacagatataagggccatgaatggagaagctgtacatgcgagtcctaggaagaccggcatgattattttaggaggtggtcttccaaagcatcacatctgcaatgccaatatgatgcgtaatggtgcagactacgctgtttttattaataccgcacaagaatttgatggtagtgattcgggagctcgtccagatgaagctgtttcctggggaaaaatacgaggatctgcaaaaactgttaaggtacatcgtctatatgatttcacaattacttttcttcttgtcagaattctctaaattgctgcggtgaatgctatggctatagtttcatacttttggattattgtagccagctaatatcatcaatcatcatcctgatttagaatatgactgaaaattccaaggttcatccaattttatattataaaatacaaccatgatttctactaacattagcagaattgcaaaatatgctgatgtccattgttcttgttatatttgttggacttctaaagatttatgtaacgtaagtcatgaataaatatttgtcttaatctctatgcttacaaatatgttgatttcattaaaccaggtccactgcgatgcaaccatcgccttccctttgcttgttgccgaaacatttgccccaagagtgaaaccttgcaatcaatagaggttaagacaaactaactgtcaagtttgcgtaaattgcattgtttgaggacattgatgaacgtgttcaccgttggtattcgattaggtcaacatgcctgtattcgatcggtatctccatcactatcgtgtgcattttatgttataccataaaagaaaaagtaatacactaattctgactgcatgagagacaggaattatagatgcagtaaccaattttcattgatttatgtgagttttgggatgaggatgattgtaacttctaaaacaaataacattagaaacttgaaagttca

SEQ ID NO: 83 - DNA, 107 bp, Arachis ipaensis
aatcacaatccctaaaaccaaaaacactgaaaagtgaaaacacatcatattccactctctgccgccggcaccgcgacgattatcacctctttcagaagctcaggtag

SEQ ID NO: 84 - DNA, 104 bp, Arachis ipaensis
  misc_feature: intron 1
gtgcttaagctttcactcttcatctgttgtattttagtttagataaatattccttctgtcttcatctgtgaattgagttttgttgttataaaactttatcccag

SEQ ID NO: 85 - DNA, 284 bp, Arachis ipaensis
  misc_feature: exon 2
tatcatagcacgtttgtgctcctcgtactgtgttgcaattttcacaagaacttctcagcttgggattcagctcgatgggtgaggcaaaggaagataatgttgttctatcttcagttcactccacagtcttcaaagaatccgaaaatctagaaggaaaatgcaccaaaattgaaggctatgacttcaaccaaggcgtcaattatcatcagcttctcaagtccatggtcaccactggctttcaagcttcaaacctaggagacgcaatccaagtcattaatcaaatg

SEQ ID NO: 86 - DNA, 103 bp, Arachis ipaensis; identical to SEQ ID NO: 70
  misc_feature: intron 2

SEQ ID NO: 87 - DNA, 168 bp, Arachis ipaensis
  misc_feature: exon 3
ctagattggaggctcgctgatgaaccagtagtcgatgattgcagtgaggaagagagggatttgggttaccgaaggtctgttacgtgcaaggtgtttctgggattcacttctaatctcatctcctctggtgttagagacactgttcggtttctcgttcaacatcacatg

SEQ ID NO: 88 - DNA, 471 bp, Arachis ipaensis
  misc_feature: intron 3
gtgagtatcctgtaagcgtaaattgggaagttggttccccttaatttgtgttaacatgataaatgtttggttttcggttgtatctggaaaaatatctgttttagtgtgttgtttgtagtgtcataaaatgattgtaagatggaagaattgaaaaaacttttgtagctggtgcatataatgtatatagtatctctagttcactaccaagtattttgtagcatagcatcgtgaaagtagagactttgttgttagattgttcatcaatagggtgacaagcatcacattgactgattgttgctaatccccttgattagagataaatttaaatttaactgattgcctttgaacaatgatagagtgtgtacttgttgaattccaaaagtaattttcaaaaggaagtgtttttttttcctttggaaaaataaattaaattcaaattgtgatagtattataattcttgatctgttacag

SEQ ID NO: 89 - DNA, 219 bp, Arachis ipaensis
  misc_feature: exon 4
gttgatgtaattgtgacaactactggcggcattgaggaagatcttataaagtgccttgcaccaacatacaaaggagatttctctctggatggagcctatctgcgctcaaagggattgaatcgtattggtaatttgttggtccctaatgacaattattgcaaatttgaggactggattattcccatttttgatcagatgttgacagaacaaaataatgag

SEQ ID NO: 90 - DNA, 286 bp, Arachis ipaensis
  misc_feature: intron 4
gtactttattttatagctgtcttgtagtgtgtgtaagtttttgtggatgcatggggacttatttaccatctgtctttgttttcctttttcaatattagtgtcgtctgtatttgtattatactattctgtatatgttttgtttatggtaagttgctaacaaaattaactaaaatagattaacattttaaaattgaatggcatacctctgatgaagcaggtgctacttgaaacttgtttttcccgacacttgttcatcttactcttttttcttcttcctttttgacag

SEQ ID NO: 91 - DNA, 87 bp, Arachis ipaensis; identical to SEQ ID NO: 75
  misc_feature: exon 5

SEQ ID NO: 92 - DNA, 232 bp, Arachis ipaensis
  misc_feature: intron 5
gtaaggctgtgggagcaaaggtttttttataatcatgttattccctgcattttgttcctgattcaagtcttcgcctagttccttttccgagcattaggttattgtttctctatatttcttgtatcatgtatgtatacgatgaaacgtagttattgtgtaaatttcctgattttctaaacagcattgatttagaaaatcacaattattgttgagtttctttcatgttttccag

SEQ ID NO: 93 - DNA, 106 bp, Arachis ipaensis; identical to SEQ ID NO: 77
  misc_feature: exon 6

SEQ ID NO: 94 - DNA, 79 bp, Arachis ipaensis
  misc_feature: intron 6
gtcttttctactctcttttgccttcctacttcctgagtgaatctgaattgtgtagaatgacaacttttcaatgtaacag

SEQ ID NO: 95 - DNA, 236 bp, Arachis ipaensis; identical to SEQ ID NO: 79
  misc_feature: exon 7

SEQ ID NO: 96 - DNA, 349 bp, Arachis ipaensis
  misc_feature: intron 7
gtacatcgtctatatgatttcacaattacttttcttcttgtcagaattctctaaattgctgcggtgaatgctatggctatagtttcatacttttggattattgtagccagctaatatcatcaatcatcatcctgatttagaatatgactgaaaattccaaggttcatccaattttatattataaaatacaaccatgatttctactaacattagcagaattgcaaaatatgctgatgtccattgttcttgttatatttgttggacttctaaagatttatgtaacgtaagtcatgaataaatatttgtcttaatctctatgcttacaaatatgttgatttcattaaaccag

SEQ ID NO: 97 - DNA, 376 bp, Arachis ipaensis
  misc_feature: exon 8
gtccactgcgatgcaaccatcgccttccctttgcttgttgccgaaacatttgccccaagagtgaaaccttgcaatcaatagaggttaagacaaactaactgtcaagtttgcgtaaattgcattgtttgaggacattgatgaacgtgttcaccgttggtattcgattaggtcaacatgcctgtattcgatcggtatctccatcactatcgtgtgcattttatgttataccataaaagaaaaagtaatacactaattctgactgcatgagagacaggaattatagatgcagtaaccaattttcattgatttatgtgagttttgggatgaggatgattgtaacttctaaaacaaataacattagaaacttgaaagttca

SEQ ID NO: 98 - DNA, 2280 bp, Arabidopsis thaliana
atttgtcagcaaagattcgtttgaagatagttcatctttattccttcccctagaaccctagaactcccaaaaccctctactactacactttcagatccaaggaaatcaattttgtcattcgagcaacatggaggatgatcgtgttttctcttcggttcactcaacagttttcaaagaatccgaatcattggaaggaaagtgtgataaaatcgaaggatacgatttcaatcaaggagtagattacccaaagcttatgcgatccatgctcaccaccggatttcaagcctcgaatctcggcgaagctattgatgtcgtcaatcaaatggttcgtttctcgaattcatcaaaaataaaaattccttctttttgttttcctttgttttgggtgaattagtaatgacaaagagtttgaatttgtattgaagctagattggagactggctgatgaaactacagtagctgaagactgtagtgaagaggagaagaatccatcgtttagagagtctgtcaagtgtaaaatctttctaggtttcacttcaaatcttgtttcatctggtgttagagatactattcgttatcttgttcagcatcatatggtttgtgatttttgctttatcaccctgcttttttatagatgttaaaattttcgagctttagttttgatttcaatggtttttctgcaggttgatgttatagtcacgacaactggtggtgttgaggaagatctcataaaatgccttgcacctacatttaaaggtgatttctctctacctggagcttatttaaggtcaaagggattgaaccgaattgggaatttgctggttcctaatgataactactgcaagtttgaggattggatcattcccatctttgacgagatgttgaaggaacagaaagaagaggtattgctttatctttcctttttatatgatttgagatgattctgtttgtgcgtcactagtggagatagattttgattcctctcttgcatcattgacttcgttggtgaatccttctttctctggtttttccttgtagaatgtgttgtggactccttctaaactgttagcacggctgggaaaagaaatcaacaatgagagttcatacctttattgggcatacaaggtatccaaaattttaacctttttagttttttaatcatcctgtgaggaactcggggatttaaattttccgcttcttgtggtgtttgtagatgaatattccagtattctgcccagggttaacagatggctctcttggggatatgctgtattttcactcttttcgtacctctggcctcatcatcgatgtagtacaaggtacttcttttactcaataagtcagtgtgataaatattcctgctacatctagtgcaggaatattgtaactagtagtgcattgtagcttttccaattcagcaacggactttactgtaagttgatatctaaaggttcaaacgggagctaggagaatagcataggggcattctgatttaggtttggggcactgggttaagagttagagaataataatcttgttagttgtttatcaaactctttgatggttagtctcttggtaatttgaattttatcacagtgtttatggtctttgaaccagttaatgttttatgaacagatatcagagctatgaacggcgaagctgtccatgcaaatcctaaaaagacagggatgataatccttggagggggcttgccaaagcaccacatatgtaatgccaatatgatgcgcaatggtgcagattacgctgtatttataaacaccgggcaagaatttgatgggagcgactcgggtgcacgccctgatgaagccgtgtcttggggtaaaattaggggttctgctaaaaccgttaaggtctgctttttaatttcttcacatcctaatttatatctcactcagtggttttgagtacatatttaatattggatcattcttgcaggtatactgtgatgctaccatagccttcccattgttggttgcagaaacatttgccacaaagagagaccaaacctgtgagtctaagacttaagaactgactggtcgttttggccatggattcttaaagatcgttgctttttgattttacactggagtgaccatataacactccacattgatgtggctgtgacgcgaattgtcttcttgcgaattgtactttagtttctctcaacctaaaatgatttgcagattgtgttttcgtttaaaacacaagagtcttgtagtcaataatcctttgccttataaaattattcagttccaacaa

SEQ ID NO: 99 - DNA, 325 bp, Arabidopsis thaliana
  misc_feature: exon 1
atttgtcagcaaagattcgtttgaagatagttcatctttattccttcccctagaaccctagaactcccaaaaccctctactactacactttcagatccaaggaaatcaattttgtcattcgagcaacatggaggatgatcgtgttttctcttcggttcactcaacagttttcaaagaatccgaatcattggaaggaaagtgtgataaaatcgaaggatacgatttcaatcaaggagtagattacccaaagcttatgcgatccatgctcaccaccggatttcaagcctcgaatctcggcgaagctattgatgtcgtcaatcaaatg

SEQ ID NO: 100 - DNA, 100 bp, Arabidopsis thaliana
  misc_feature: intron 1
gttcgtttctcgaattcatcaaaaataaaaattccttctttttgttttcctttgttttgggtgaattagtaatgacaaagagtttgaatttgtattgaag

SEQ ID NO: 101 - DNA, 171 bp, Arabidopsis thaliana
  misc_feature: exon 2
ctagattggagactggctgatgaaactacagtagctgaagactgtagtgaagaggagaagaatccatcgtttagagagtctgtcaagtgtaaaatctttctaggtttcacttcaaatcttgtttcatctggtgttagagatactattcgttatcttgttcagcatcatatg

SEQ ID NO: 102 - DNA, 87 bp, Arabidopsis thaliana
  misc_feature: intron 2
gtttgtgatttttgctttatcaccctgcttttttatagatgttaaaattttcgagctttagttttgatttcaatggtttttctgcag

SEQ ID NO: 103 - DNA, 219 bp, Arabidopsis thaliana
  misc_feature: exon 3
gttgatgttatagtcacgacaactggtggtgttgaggaagatctcataaaatgccttgcacctacatttaaaggtgatttctctctacctggagcttatttaaggtcaaagggattgaaccgaattgggaatttgctggttcctaatgataactactgcaagtttgaggattggatcattcccatctttgacgagatgttgaaggaacagaaagaagag

SEQ ID NO: 104 - DNA, 136 bp, Arabidopsis thaliana
  misc_feature: intron 3
gtattgctttatctttcctttttatatgatttgagatgattctgtttgtgcgtcactagtggagatagattttgattcctctcttgcatcattgacttcgttggtgaatccttctttctctggtttttccttgtag

SEQ ID NO: 105 - DNA, 87 bp, Arabidopsis thaliana
  misc_feature: exon 4
aatgtgttgtggactccttctaaactgttagcacggctgggaaaagaaatcaacaatgagagttcatacctttattgggcatacaag

SEQ ID NO: 106 - DNA, 88 bp, Arabidopsis thaliana
  misc_feature: intron 4
gtatccaaaattttaacctttttagttttttaatcatcctgtgaggaactcggggatttaaattttccgcttcttgtggtgtttgtag

SEQ ID NO: 107 - DNA, 106 bp, Arabidopsis thaliana
  misc_feature: exon 5
atgaatattccagtattctgcccagggttaacagatggctctcttggggatatgctgtattttcactcttttcgtacctctggcctcatcatcgatgtagtacaag

SEQ ID NO: 108 - DNA, 316 bp, Arabidopsis thaliana
  misc_feature: intron 5
gtacttcttttactcaataagtcagtgtgataaatattcctgctacatctagtgcaggaatattgtaactagtagtgcattgtagcttttccaattcagcaacggactttactgtaagttgatatctaaaggttcaaacgggagctaggagaatagcataggggcattctgatttaggtttggggcactgggttaagagttagagaataataatcttgttagttgtttatcaaactctttgatggttagtctcttggtaatttgaattttatcacagtgtttatggtctttgaaccagttaatgttttatgaacag

SEQ ID NO: 109 - DNA, 236 bp, Arabidopsis thaliana
  misc_feature: exon 6
atatcagagctatgaacggcgaagctgtccatgcaaatcctaaaaagacagggatgataatccttggagggggcttgccaaagcaccacatatgtaatgccaatatgatgcgcaatggtgcagattacgctgtatttataaacaccgggcaagaatttgatgggagcgactcgggtgcacgccctgatgaagccgtgtcttggggtaaaattaggggttctgctaaaaccgttaag

SEQ ID NO: 110 - DNA, 85 bp, Arabidopsis thaliana
  misc_feature: intron 6
gtctgctttttaatttcttcacatcctaatttatatctcactcagtggttttgagtacatatttaatattggatcattcttgcag

SEQ ID NO: 111 - DNA, 324 bp, Arabidopsis thaliana
  misc_feature: exon 7
gtatactgtgatgctaccatagccttcccattgttggttgcagaaacatttgccacaaagagagaccaaacctgtgagtctaagacttaagaactgactggtcgttttggccatggattcttaaagatcgttgctttttgattttacactggagtgaccatataacactccacattgatgtggctgtgacgcgaattgtcttcttgcgaattgtactttagtttctctcaacctaaaatgatttgcagattgtgttttcgtttaaaacacaagagtcttgtagtcaataatcctttgccttataaaattattcagttccaacaa

SEQ ID NO: 112 - DNA, 2142 bp, Brassica napus
ggttgtgtctttttccctgtctgctagcttgctagaaccctaaaactccctcccaaaactctccacatcttccgagaaagaagatggaggaggatcgtgttctctcatctgttcactccaccgtcttcaaggaatcagaatcgttggaaggaaagtgcgacaaaatcgaaggatacgatttcaaccaaggagtaaactacccgaagcttctccgatccatgctcacaaccggcttccaagcctcgaatctcggcgaagctattgatatcgttaatcaaatggttcgagaagttaaagttactttttgatattgagcttagttttgtttgaatcagtaaacattggtctttgaattgtatttgaagctagagtggagactctctgatgaaactatagcacctgaagactgtagtgaagaggagaaggatccagcgtatagagagtccgtgaagtgtaaaatctttctaggcttcacttcgaatcttgtttcgtctggtgttagagagactattcgataccttgttcagcatcatatggttagtgactagttttagtttaaatgacttggcctgtcttttacatgggaagttgctgtttgattgattttaatgattcttttcaggttgatgttatagttactacaactggtggcgtagaggaagatcttatcaaatgccttgctcctactttcaaaggtgacttctctctaccgggtgcgtatcttcggtcaaagggattgaaccggatcgggaacttgcttgttccgaatgataactactgcaagtttgaggattggatcattcccatctttgaccagatgttgaaggaacagaaagaagaggtatcattgctaccacatcttttttacgtgttaccaagttccaagttcgtctcttgcatcataccttcgttgatttacccttcttatgttcattgtagaatgtgttgtggacaccttctaaactgttagcgcgtttgggaaaagaaataaacaatgagagttcatacctttattgggcatacaaggtaacaagaatatttacacctttgtagtatttttcggtttgaaactccagggttgattttttttttttttcttctgacttttgtggtgtttgtagatgaatattccagtattctgcccggggttaacagatggctctctcggtgatatgctctattttcactcctttcgtacctctggccttgtcatcgatgttgtgcaaggtaccttctttcactcaatgaggcaatgtcataagagtttgttttcttgctaagcctagtacaagactattgtagctagcagtgagttgtaaatgttgtaagatagattggagttagagactattttacaggttttgtatgggtcgttgggtgagagttagagtgttctcttgttaatcaaactctgtgctgtagtgtagccagtggtttgctgagtgtgaataaaggagtttgttgttctgagtctttatctcaatgctggattataagatatggttacttaaccagttcatgtttgatgagcagatatcagagctatgaacggagaagctgtccatgctactccaagaaagacagggatgataatcctcggaggcggcttgccgaagcaccacatatgtaatgccaacatgatgcgtaacggtgcggactacgctgtgttcataaacacagggcaagagtttgatgggagtgactctggtgcacgccctgatgaagcagtgtcttggggtaaaataagggggtctgctaaaaccgttaaggtctcattcagaccttctttgattttttcgcgtctttactagtgtttttagttacgttttttgatgatggatcatttcttgcaggtatactgtgatgctaccatagcctttcctttgttggttgctgaaacatttgcctccaagagagaacaaaactgtgagcacaagacctaagcccaagaaagcttacgtctcttttatcggtttgttcttccatcttgttgttgtaccctttgtcctgctttacataacattcatctctaaaacaatactacctccttttgacaaaaaataaaaaaaattggaaaaatggtttcacaagaataatatttttgtgtgctcaataaattttgtattatttaatgacagtaaa

SEQ ID NO: 113 - DNA, 281 bp, Brassica napus
  misc_feature: exon 1
ggttgtgtctttttccctgtctgctagcttgctagaaccctaaaactccctcccaaaactctccacatcttccgagaaagaagatggaggaggatcgtgttctctcatctgttcactccaccgtcttcaaggaatcagaatcgttggaaggaaagtgcgacaaaatcgaaggatacgatttcaaccaaggagtaaactacccgaagcttctccgatccatgctcacaaccggcttccaagcctcgaatctcggcgaagctattgatatcgttaatcaaatg

SEQ ID NO: 114 - DNA, 84 bp, Brassica napus
  misc_feature: intron 1
gttcgagaagttaaagttactttttgatattgagcttagttttgtttgaatcagtaaacattggtctttgaattgtatttgaag

SEQ ID NO: 115 - DNA, 171 bp, Brassica napus
  misc_feature: exon 2
ctagagtggagactctctgatgaaactatagcacctgaagactgtagtgaagaggagaaggatccagcgtatagagagtccgtgaagtgtaaaatctttctaggcttcacttcgaatcttgtttcgtctggtgttagagagactattcgataccttgttcagcatcatatg

SEQ ID NO: 116 - DNA, 86 bp, Brassica napus
  misc_feature: intron 2
gttagtgactagttttagtttaaatgacttggcctgtcttttacatgggaagttgctgtttgattgattttaatgattcttttcag

SEQ ID NO: 117 - DNA, 219 bp, Brassica napus
  misc_feature: exon 3
gttgatgttatagttactacaactggtggcgtagaggaagatcttatcaaatgccttgctcctactttcaaaggtgacttctctctaccgggtgcgtatcttcggtcaaagggattgaaccggatcgggaacttgcttgttccgaatgataactactgcaagtttgaggattggatcattcccatctttgaccagatgttgaaggaacagaaagaagag

SEQ ID NO: 118 - DNA, 98 bp, Brassica napus
  misc_feature: intron 3
gtatcattgctaccacatcttttttacgtgttaccaagttccaagttcgtctcttgcatcataccttcgttgatttacccttcttatgttcattgtag

SEQ ID NO: 119 - DNA, 87 bp, Brassica napus
  misc_feature: exon 4
aatgtgttgtggacaccttctaaactgttagcgcgtttgggaaaagaaataaacaatgagagttcatacctttattgggcatacaag

SEQ ID NO: 120 - DNA, 95 bp, Brassica napus
  misc_feature: intron 4
gtaacaagaatatttacacctttgtagtatttttcggtttgaaactccagggttgattttttttttttttcttctgacttttgtggtgtttgtag

SEQ ID NO: 121 - DNA, 106 bp, Brassica napus
  misc_feature: exon 5
atgaatattccagtattctgcccggggttaacagatggctctctcggtgatatgctctattttcactcctttcgtacctctggccttgtcatcgatgttgtgcaag

SEQ ID NO: 122 - DNA, 306 bp, Brassica napus
  misc_feature: intron 5
gtaccttctttcactcaatgaggcaatgtcataagagtttgttttcttgctaagcctagtacaagactattgtagctagcagtgagttgtaaatgttgtaagatagattggagttagagactattttacaggttttgtatgggtcgttgggtgagagttagagtgttctcttgttaatcaaactctgtgctgtagtgtagccagtggtttgctgagtgtgaataaaggagtttgttgttctgagtctttatctcaatgctggattataagatatggttacttaaccagttcatgtttgatgagcag

SEQ ID NO: 123 - DNA, 236 bp, Brassica napus
  misc_feature: exon 6
atatcagagctatgaacggagaagctgtccatgctactccaagaaagacagggatgataatcctcggaggcggcttgccgaagcaccacatatgtaatgccaacatgatgcgtaacggtgcggactacgctgtgttcataaacacagggcaagagtttgatgggagtgactctggtgcacgccctgatgaagcagtgtcttggggtaaaataagggggtctgctaaaaccgttaag

SEQ ID NO: 124 - DNA, 84 bp, Brassica napus
  misc_feature: intron 6
gtctcattcagaccttctttgattttttcgcgtctttactagtgtttttagttacgttttttgatgatggatcatttcttgcag

SEQ ID NO: 125 - DNA, 289 bp, Brassica napus
  misc_feature: exon 7
gtatactgtgatgctaccatagcctttcctttgttggttgctgaaacatttgcctccaagagagaacaaaactgtgagcacaagacctaagcccaagaaagcttacgtctcttttatcggtttgttcttccatcttgttgttgtaccctttgtcctgctttacataacattcatctctaaaacaatactacctccttttgacaaaaaataaaaaaaattggaaaaatggtttcacaagaataatatttttgtgtgctcaataaattttgtattatttaatgacagtaaa

SEQ ID NO: 126 - DNA, 1975 bp, Brassica rapa
tggttgtgtctttttccctgtctgctactagcttgctagaaccctaaaactccctcccaaaactctccacatcttccgagaaagaagatggaggaggatcgtgttctctcatctgttcactccaccgtcttcaaggaatccgaatcgttagaaggaaagtgcgacaaaatcgaaggatacgatttcaaccaaggagtaaactaccccaagcttctccgatccatgctcacaacgggcttccaagcctcaaacctcggcgaagctattgatgtcgttaatcaaatggttagagaaagttttaagttcccttgtctgagcttagtttttgtctaaaatcattaacgtggaggttttgaattgtatttgaagctagagtggagactctctgatgaaactatagcacctgaagactgtagtgaagaggagaaggacccagcgtatagagagtccgtgaagtgtaaaatctttctaggcttcacttcgaatcttgtttcctctggtgttagagagactattcgataccttgttcagcatcatatggttagtgactagttttagtttaaatgacttggcctgtcttttacttgggaagttgctgtttggttgattttaatgattcttttcaggttgatgttatagttactacaactggtggcgtagaggaagatctcatcaaatgccttgctcctactttcaaaggtgatttctctctaccgggtgcgtatcttcggtcaaagggattgaaccggatcgggaacttgcttgttccgaatgataactactgcaagtttgaggattggatcattcccatctttgaccagatgttgaaggaacagaaagaagaggtattattgatttccattcttttgttttttttcgagtggggagatagattattcctctcttgatgataatccttattatgttgattgtagagtgtgttgtggacgccttctaaattgttagcgcggctggggaaagaaataaataatgagagttcatatctttattgggcatacaaggtaacataaaaacttagcctttatatagtattttgggcatataaaggtaggtaacaaggttcatgtctcatgtggtgtttgtagatgaatattccagtgttctgcccggggttaaccgatggctctctcggtgatatgttgtattttcactcattccgtacctctggccttgtcattgacgtagtgcaaggtaccttctttcacttcatgaggcaatggcatgtgctactaagtctagtgcaagactattgtaactagcagtgaattgtaaatgttttaatggattataagaaatgactgaaccagttaatgcttgatgaacagatatcagagctatgaacggtgaagcagtccatgctactccaagaaagacagggatgataatccttggagggggcttgccgaagcaccacatatgtaatgccaacatgatgcgtaacggtgcggactacgctgtgttcataaacacagggcaagagtttgatgggagtgactctggtgcacgccctgatgaggcagtgtcttggggtaaaataaggggatctgctaaaaccgttaaggtctcattcaaaccttcttttgatttttttcgcgtctttactagtgttttgagttacattttttgatgatggatcatttcttgcaggtatactgtgatgctactatagccttccctttgttggttgcagaaacatttgcctccaagagagaacaaaactgtgagcacaagacctaagcccaagaaagcttacgtctcatttatcggtttgttcttccatcttgttgttgtaccctttgtcctgctttacataacattcatctctaaaacaatactacctccttttgacaaaaaaaaaaattggaaaaaatggtttcacaagaataatatttttatgtgctcaataaattttgtattatttaatgacagtaaattgttaatgttagaagattaa

SEQ ID NO: 127 - DNA, 285 bp, Brassica rapa
  misc_feature: exon 1
tggttgtgtctttttccctgtctgctactagcttgctagaaccctaaaactccctcccaaaactctccacatcttccgagaaagaagatggaggaggatcgtgttctctcatctgttcactccaccgtcttcaaggaatccgaatcgttagaaggaaagtgcgacaaaatcgaaggatacgatttcaaccaaggagtaaactaccccaagcttctccgatccatgctcacaacgggcttccaagcctcaaacctcggcgaagctattgatgtcgttaatcaaatg

SEQ ID NO: 128 - DNA, 285 bp, Brassica rapa; identical to SEQ ID NO: 127
  misc_feature: intron 1

SEQ ID NO: 129 - DNA, 171 bp, Brassica rapa
  misc_feature: exon 2
ctagagtggagactctctgatgaaactatagcacctgaagactgtagtgaagaggagaaggacccagcgtatagagagtccgtgaagtgtaaaatctttctaggcttcacttcgaatcttgtttcctctggtgttagagagactattcgataccttgttcagcatcatatg

SEQ ID NO: 130 - DNA, 86 bp, Brassica rapa
  misc_feature: intron 2
gttagtgactagttttagtttaaatgacttggcctgtcttttacttgggaagttgctgtttggttgattttaatgattcttttcag

SEQ ID NO: 131 - DNA, 219 bp, Brassica rapa
  misc_feature: exon 3
gttgatgttatagttactacaactggtggcgtagaggaagatctcatcaaatgccttgctcctactttcaaaggtgatttctctctaccgggtgcgtatcttcggtcaaagggattgaaccggatcgggaacttgcttgttccgaatgataactactgcaagtttgaggattggatcattcccatctttgaccagatgttgaaggaacagaaagaagag

SEQ ID NO: 132 - DNA, 90 bp, Brassica rapa
  misc_feature: intron 3
gtattattgatttccattcttttgttttttttcgagtggggagatagattattcctctcttgatgataatccttattatgttgattgtag

SEQ ID NO: 133 - DNA, 87 bp, Brassica rapa
  misc_feature: exon 4
agtgtgttgtggacgccttctaaattgttagcgcggctggggaaagaaataaataatgagagttcatatctttattgggcatacaag

SEQ ID NO: 134 - DNA, 84 bp, Brassica rapa
  misc_feature: intron 4
gtaacataaaaacttagcctttatatagtattttgggcatataaaggtaggtaacaaggttcatgtctcatgtggtgtttgtag

SEQ ID NO: 135 - DNA, 106 bp, Brassica rapa
  misc_feature: exon 5
atgaatattccagtgttctgcccggggttaaccgatggctctctcggtgatatgttgtattttcactcattccgtacctctggccttgtcattgacgtagtgcaag

SEQ ID NO: 136 - DNA, 134 bp, Brassica rapa
  misc_feature: intron 5
gtaccttctttcacttcatgaggcaatggcatgtgctactaagtctagtgcaagactattgtaactagcagtgaattgtaaatgttttaatggattataagaaatgactgaaccagttaatgcttgatgaacag

SEQ ID NO: 137 - DNA, 236 bp, Brassica rapa
  misc_feature: exon 6
atatcagagctatgaacggtgaagcagtccatgctactccaagaaagacagggatgataatccttggagggggcttgccgaagcaccacatatgtaatgccaacatgatgcgtaacggtgcggactacgctgtgttcataaacacagggcaagagtttgatgggagtgactctggtgcacgccctgatgaggcagtgtcttggggtaaaataaggggatctgctaaaaccgttaag

SEQ ID NO: 138 - DNA, 86 bp, Brassica rapa
  misc_feature: intron 6
gtctcattcaaaccttcttttgatttttttcgcgtctttactagtgttttgagttacattttttgatgatggatcatttcttgcag

SEQ ID NO: 139 - DNA, 307 bp, Brassica rapa
  misc_feature: exon 7
gtatactgtgatgctactatagccttccctttgttggttgcagaaacatttgcctccaagagagaacaaaactgtgagcacaagacctaagcccaagaaagcttacgtctcatttatcggtttgttcttccatcttgttgttgtaccctttgtcctgctttacataacattcatctctaaaacaatactacctccttttgacaaaaaaaaaaattggaaaaaatggtttcacaagaataatatttttatgtgctcaataaattttgtattatttaatgacagtaaattgttaatgttagaagattaa

SEQ ID NO: 140 - DNA, 4993 bp, Beta vulgaris subsp. Vulgaris
aacttacttttagaattcttctcaaaacaaaaaaaaaaaaaaaaacaaaacttgcttttacaatagttttcagggttttagtctgagagctcaatctgtgaatcttaaacccttttcctcaaactgtgatttctgttgcaaaattatctcaactactcaaattatcttctcatagtttcaattaaagaaacgaaaatggaagacaatactatggcatcggttcactccacagttttcaaagaatcagaaaccctagaaggaaaatgcatcaaaattcagggctatgatttcaatcaaggagtaaattattcgcaactcgtaaaatctttcatttccactggtttccaagcatcaaatcttggagaagccattgaagtagtaaatcaaatggttagaacaagttttaatttttgaattttacatacttcaaatataatcctaatttcgcaatatttattttgttttgatatgatttgatttgattttgctgctgttgaagctagattggaggctttcagatgaagtacctgccgaagactgtagtatggaggagagcgattctgattacagaaattctgtgaggtgcaaaatattccttgggtttacatcaaatttaatttcatctgggattcgtgacacggttcgatatcttgttcagaatcatatggtgaggaagaaccatgcacattatttttactttatgatttttaaatgggttacaaaacttgattgctctgtattacaatttaagcttttctttgaaaaaatctcatgtagtagtatgtttctgatgttttgtctaattatatgtgcttaagtcgagtagttgcttgatattttgtagtttttaggatgtgagagatccattttatgtgtttccttctgtggttatgtttgattatattgtgggttacaacaattttccttgactcttaacctcacagaaggatttcattgagctttgccaagctcataatagttacgaacacattgtgaaccaagggttaaaggggcgagggggtttggggaagagtcagtggcgtatccaggaacttacggatacataagcagttagactcgtcaatttttgtttgaatataaagctgtatagaagtaaataatttttgtctgcccaagtaagaacttagatatgattgctaagtgtttaattgtttaaattttcaatttaaataaccagatctttgaagctaagttgtttaattaacatactcttttaagtcattctcttcttaactgattaactatttcgtttaagttaggttattctttttctagatgtacatcaaaattatctataactattaaacaaatttatacttcaattatatgtaataaaaaaaattgaatatatatattgactgaatgctacacatttagaaaatttaacaattaatgtgaagttgaaaatttctttaaaaatagttgtttaagtatataaatgaggaaaaatttgagggaaaaaagagaaacaagaatattattttagagcttttatctaagtaagcttatgaatttgtacttgcggattaataggcagtagtatgtactaaataatagaagtactgaaggaaaacatgagttaaaggggagtaattaaaagcaaaatataaatatgtggggattcgaatgcaagacctcccccatgcaccactgatctttcttgtcgcttcccctaccagcaagacaagcctcataagatgttcattgcttacatattctattttttgtcctaattttagtttcttgtcattattttctagagttaatgggggtacagctgtacctcttgtatcacccctagattcgccaatgggaagagtgtataaattacggggcactttgggtagtttgctaagatttttagcagaggatcctggcattttacaggttttatttgctagaaagctagaatgagttttttgttttattagaaaacaacatttgattgtcatacatacacctgcaggttcatgtgattgctacaactgctggtgggatagaagaagatcttattaaatgtcttgcacctacatttagaggtgaattttctctacctggagctcaattacgttcaaaaggattgaatcggattggtaatttgttggttcccaatgacaactactgcaaatttgaggattggattattcccatatttgataaaatgttaaaggagcaaaattcagaggtaaattattgttttggctgtgttatatggtaaaacaaacgagtgcatttgtgtttctttagctgtttgatgtgcctgctattatttcattactcattgatatacttttcactgaaaagaagtgtgagtccattttcagctctcccgtcccgaaataagaactctagcagccttgtttaaagaaagcgtgataaaatatgtatgtaatatattaccgctgcatgtataggaaatgacctagtatagagtaagacttccaaagttaatggactgtttatttctctttcaaatgcattcttaattcaaggcattttctttgagtatattttgtcttcagacttcaggttgatgatagcagtagaactctgtgagcagtagcgctgcttaatcagcacagcgtttatgcaactatctgtttctggataaatggtttcacgttgaatcacagtaagtagaggtcgttaagggttctgatcagctttttgaagtgccaaattgtaagatagtttatgtttcactcaaaattgttattcccttctatagttctatgagcaagaaaatgggatgagtttcacattaggtcatcacattaactgggatttactttgatttgttgccgttttatgctctagtgtctaggaaaaattatggttctgtaggttttatatttagttttatctgtatttcaatagaagagaagtgaagagctgattaattttcaggtatttgcaattcttggttagcttccatagtactatgatgcatgcagtgaagataacctttgtttcaagacaagggttttttcttaggaatgagctaaggggagaaataatgatattttaaaagagaactttttttaccatgtcatgaaaattgcttgctgcctctcaagtacattatctacatggagcgtgcaggatattaaaacaggaactgctgataggtggggctatatgtatgtcgactatagatagttacccttcatgttagtcccccttctttttccccacaggaagagctttttttttgctagactttttgtccaatctcccatcaagcaacattgttccattttctaatatttccttttaagttccttttttgattttgtacactcttacttctagtcatcttatacatgtgtatgtgtgcgtgtgactgtgtgtgtgttttcccttctcatacttttagataatgtttgcagaagattacatggacaccatctaaggtgattgctcgtttggggaaagaaattgatgatgaaagttcatatctttattgggcgtacaaggtgagcaatcttgtaatttgggccgtcttaaaaattttgaggcccttgttctaattataaagttggccttaaatataaaaatattatgcatagattgtaaaatataaataaagtattctacaaaatatattattgctaaaatatttctgaaaaaataaagctcgaacaatatgactaagaaaaatatttaaattgagacttttgagccatcaaaaaagcgagaccctgttctgttggtcgctttgcaagctctattagacggctctgataccatactgacatatggaggagtaaaagttggaaggaaaaaaattgcctagtctcatcctcttaatcatttaacgaattttcatcatattcataattgaagggtttctaacttctttttggtggtatgtaaagtctaaattatgatttataaggtcttgtgcattttgtttcaatttactatgcagtatttaagcactctattgtatgttcctttttgctgattgacaactccatgcctgacctttacacttatttacgttaatctccagaacaatattcctgtcttctgccctggtttaacagatggatcactaggggatatgttatattttcattcattccgcaacccaggtttaattattgatattgtgcaaggtatgttatacttctattttgcttgatgtcaatagatcttactctattagtcaggaagttattttttttttttaattgtaaaccagatattagggcgatgaacggtgaggctgttcatgcagctcctaggaagactggagtgatagttcttgggggtggattgccaaagcatcatatttgcaatgccaatatgatgcgtaatggcgcagattatgcagtttttgtcaatactgctcaggagtttgatggtagtgattcaggtgctcgtcctgatgaggccgtgtcctggggaaagattcgaggatctgcaaagactgttaaggtatgtctttttgtttccttttttctttcccttatagggttcctctttgattgtagccgcccaagtctgcatgtgttttagacggttctgatgcttgcatttttcttgcaagcaggtgcactgtgatgctactattgcttttcctctattagttgctgagacttttgctgctaagagaaaaaattaaagctgatgcccgtttctgatctcaaagggttgccttttgtttcaagttattgatacaatttggagcatgctgctgaagtaacatggaatgtgtcaatccataaactcgaggggtgaaataaggttgctgttggcatgattttcccttttttttaccattcttgttggttttcttttgagattaatcactcacaaagccaataccaacttcgttagcagattctttgttcacagcaatttgtaaccctaatatattggctaatatctgtatacagaaacaaattttacgcgagttggatttcgaaactttgttctacctttacaaaggagtgtttgtccttta

SEQ ID NO: 141 - DNA, 390 bp, Beta vulgaris subsp. Vulgaris
  misc_feature: exon 1
aacttacttttagaattcttctcaaaacaaaaaaaaaaaaaaaaacaaaacttgcttttacaatagttttcagggttttagtctgagagctcaatctgtgaatcttaaacccttttcctcaaactgtgatttctgttgcaaaattatctcaactactcaaattatcttctcatagtttcaattaaagaaacgaaaatggaagacaatactatggcatcggttcactccacagttttcaaagaatcagaaaccctagaaggaaaatgcatcaaaattcagggctatgatttcaatcaaggagtaaattattcgcaactcgtaaaatctttcatttccactggtttccaagcatcaaatcttggagaagccattgaagtagtaaatcaaatg

SEQ ID NO: 142 - DNA, 109 bp, Beta vulgaris subsp. Vulgaris
  misc_feature: intron 1
gttagaacaagttttaatttttgaattttacatacttcaaatataatcctaatttcgcaatatttattttgttttgatatgatttgatttgattttgctgctgttgaag

SEQ ID NO: 143 - DNA, 168 bp, Beta vulgaris subsp. Vulgaris
  misc_feature: exon 2
ctagattggaggctttcagatgaagtacctgccgaagactgtagtatggaggagagcgattctgattacagaaattctgtgaggtgcaaaatattccttgggtttacatcaaatttaatttcatctgggattcgtgacacggttcgatatcttgttcagaatcatatg

SEQ ID NO: 144 - DNA, 1320 bp, Beta vulgaris subsp. Vulgaris
  misc_feature: intron 2
gtgaggaagaaccatgcacattatttttactttatgatttttaaatgggttacaaaacttgattgctctgtattacaatttaagcttttctttgaaaaaatctcatgtagtagtatgtttctgatgttttgtctaattatatgtgcttaagtcgagtagttgcttgatattttgtagtttttaggatgtgagagatccattttatgtgtttccttctgtggttatgtttgattatattgtgggttacaacaattttccttgactcttaacctcacagaaggatttcattgagctttgccaagctcataatagttacgaacacattgtgaaccaagggttaaaggggcgagggggtttggggaagagtcagtggcgtatccaggaacttacggatacataagcagttagactcgtcaatttttgtttgaatataaagctgtatagaagtaaataatttttgtctgcccaagtaagaacttagatatgattgctaagtgtttaattgtttaaattttcaatttaaataaccagatctttgaagctaagttgtttaattaacatactcttttaagtcattctcttcttaactgattaactatttcgtttaagttaggttattctttttctagatgtacatcaaaattatctataactattaaacaaatttatacttcaattatatgtaataaaaaaaattgaatatatatattgactgaatgctacacatttagaaaatttaacaattaatgtgaagttgaaaatttctttaaaaatagttgtttaagtatataaatgaggaaaaatttgagggaaaaaagagaaacaagaatattattttagagcttttatctaagtaagcttatgaatttgtacttgcggattaataggcagtagtatgtactaaataatagaagtactgaaggaaaacatgagttaaaggggagtaattaaaagcaaaatataaatatgtggggattcgaatgcaagacctcccccatgcaccactgatctttcttgtcgcttcccctaccagcaagacaagcctcataagatgttcattgcttacatattctattttttgtcctaattttagtttcttgtcattattttctagagttaatgggggtacagctgtacctcttgtatcacccctagattcgccaatgggaagagtgtataaattacggggcactttgggtagtttgctaagatttttagcagaggatcctggcattttacaggttttatttgctagaaagctagaatgagttttttgttttattagaaaacaacatttgattgtcatacatacacctgcag

SEQ ID NO: 145 - DNA, 219 bp, Beta vulgaris subsp. Vulgaris
  misc_feature: exon 3
gttcatgtgattgctacaactgctggtgggatagaagaagatcttattaaatgtcttgcacctacatttagaggtgaattttctctacctggagctcaattacgttcaaaaggattgaatcggattggtaatttgttggttcccaatgacaactactgcaaatttgaggattggattattcccatatttgataaaatgttaaaggagcaaaattcagag

SEQ ID NO: 146 - DNA, 1204 bp, Beta vulgaris subsp. Vulgaris
  misc_feature: intron 3
gtaaattattgttttggctgtgttatatggtaaaacaaacgagtgcatttgtgtttctttagctgtttgatgtgcctgctattatttcattactcattgatatacttttcactgaaaagaagtgtgagtccattttcagctctcccgtcccgaaataagaactctagcagccttgtttaaagaaagcgtgataaaatatgtatgtaatatattaccgctgcatgtataggaaatgacctagtatagagtaagacttccaaagttaatggactgtttatttctctttcaaatgcattcttaattcaaggcattttctttgagtatattttgtcttcagacttcaggttgatgatagcagtagaactctgtgagcagtagcgctgcttaatcagcacagcgtttatgcaactatctgtttctggataaatggtttcacgttgaatcacagtaagtagaggtcgttaagggttctgatcagctttttgaagtgccaaattgtaagatagtttatgtttcactcaaaattgttattcccttctatagttctatgagcaagaaaatgggatgagtttcacattaggtcatcacattaactgggatttactttgatttgttgccgttttatgctctagtgtctaggaaaaattatggttctgtaggttttatatttagttttatctgtatttcaatagaagagaagtgaagagctgattaattttcaggtatttgcaattcttggttagcttccatagtactatgatgcatgcagtgaagataacctttgtttcaagacaagggttttttcttaggaatgagctaaggggagaaataatgatattttaaaagagaactttttttaccatgtcatgaaaattgcttgctgcctctcaagtacattatctacatggagcgtgcaggatattaaaacaggaactgctgataggtggggctatatgtatgtcgactatagatagttacccttcatgttagtcccccttctttttccccacaggaagagctttttttttgctagactttttgtccaatctcccatcaagcaacattgttccattttctaatatttccttttaagttccttttttgattttgtacactcttacttctagtcatcttatacatgtgtatgtgtgcgtgtgactgtgtgtgtgttttcccttctcatacttttagataatgtttgcag

SEQ ID NO: 147 - DNA, 87 bp, Beta vulgaris subsp. Vulgaris
  misc_feature: exon 4
aagattacatggacaccatctaaggtgattgctcgtttggggaaagaaattgatgatgaaagttcatatctttattgggcgtacaag

SEQ ID NO: 148 - DNA, 539 bp, Beta vulgaris subsp. Vulgaris
  misc_feature: intron 4
gtgagcaatcttgtaatttgggccgtcttaaaaattttgaggcccttgttctaattataaagttggccttaaatataaaaatattatgcatagattgtaaaatataaataaagtattctacaaaatatattattgctaaaatatttctgaaaaaataaagctcgaacaatatgactaagaaaaatatttaaattgagacttttgagccatcaaaaaagcgagaccctgttctgttggtcgctttgcaagctctattagacggctctgataccatactgacatatggaggagtaaaagttggaaggaaaaaaattgcctagtctcatcctcttaatcatttaacgaattttcatcatattcataattgaagggtttctaacttctttttggtggtatgtaaagtctaaattatgatttataaggtcttgtgcattttgtttcaatttactatgcagtatttaagcactctattgtatgttcctttttgctgattgacaactccatgcctgacctttacacttatttacgttaatctccag

SEQ ID NO: 149 - DNA, 106 bp, Beta vulgaris subsp. Vulgaris
  misc_feature: exon 5
aacaatattcctgtcttctgccctggtttaacagatggatcactaggggatatgttatattttcattcattccgcaacccaggtttaattattgatattgtgcaag

SEQ ID NO: 150 - DNA, 86 bp, Beta vulgaris subsp. Vulgaris
  misc_feature: intron 5
gtatgttatacttctattttgcttgatgtcaatagatcttactctattagtcaggaagttattttttttttttaattgtaaaccag

SEQ ID NO: 151 - DNA, 236 bp, Beta vulgaris subsp. Vulgaris
  misc_feature: exon 6
atattagggcgatgaacggtgaggctgttcatgcagctcctaggaagactggagtgatagttcttgggggtggattgccaaagcatcatatttgcaatgccaatatgatgcgtaatggcgcagattatgcagtttttgtcaatactgctcaggagtttgatggtagtgattcaggtgctcgtcctgatgaggccgtgtcctggggaaagattcgaggatctgcaaagactgttaag

SEQ ID NO: 152 - DNA, 115 bp, Beta vulgaris subsp. Vulgaris
  misc_feature: intron 6
gtatgtctttttgtttccttttttctttcccttatagggttcctctttgattgtagccgcccaagtctgcatgtgttttagacggttctgatgcttgcatttttcttgcaagcag

SEQ ID NO: 153 - DNA, 414 bp, Beta vulgaris subsp. Vulgaris
  misc_feature: exon 7
gtgcactgtgatgctactattgcttttcctctattagttgctgagacttttgctgctaagagaaaaaattaaagctgatgcccgtttctgatctcaaagggttgccttttgtttcaagttattgatacaatttggagcatgctgctgaagtaacatggaatgtgtcaatccataaactcgaggggtgaaataaggttgctgttggcatgattttcccttttttttaccattcttgttggttttcttttgagattaatcactcacaaagccaataccaacttcgttagcagattctttgttcacagcaatttgtaaccctaatatattggctaatatctgtatacagaaacaaattttacgcgagttggatttcgaaactttgttctacctttacaaaggagtgtttgtccttta

SEQ ID NO: 154 - DNA, 4373 bp, Cicer arietinum
ctggttcctttagatcgcgtgcgactcagagagagaacatactgaaaacagtgaacaacctcaaacgccgccgccgtaagataaaatagcaattcgaagcgaaggaaaaaggtaaagtattgaggtagtgtttgtgtattgaaaaagtcaacgataatgagtgagtcaaagcaagatgacatagttatggcatcagttcactccacagtcttcaaagaatcagaaagcctcgatggaacgtgtctccaaattaaaggttacgatttcaacaacggcgtcaattatcaacaacttctcaattccatgctcactactggatttcaagcttcaaaccttgctgatgccattaacgtcgttaatcaaatggttcttttctaatacactccattctctttcttttttcacatgttctcactttatgcttatttattttttaatctttttggaacatggggttgaagctagattggaggctggttgatgaacctgtgactgaggattgtgctgacgaagagagagatttggattacagaaaatctgttaagtgtaaagtgtttttgggtttcacttctaatctcatttcatctggtgttagagatgttgttcgttacctttgtcagcatcacatggtgagtgtctaatcacacctacttgctttattgattttacattttcttagctattaatttaaggatgaaagatgtacccctctgtctcacataagtgtcgttttagatattttctactttaacttctctataaaaacttaccagctgataaatatttttgttgttagttgttgtaagtaaacaatttgcaattaactcaaactcattctaattaagaatttgtgataaactacaagctaatctaaatggccatattgtcagcataaagtttaacttacttctatgttttctaaattgaaaatatatgttaggattagtgtaaagaatttaggaagaagattgttttgtaaaaccaaagacttataaagagttatttgcattgaaggtttctggaggtggattttgttttgggtataatgataggttttggtttttaggatatgtacattttgaacgcagataattttgatgattggttagttttagggttcagatatgagtgaaagtaatgaattttagcctacttgataccctaatatcttaatatttgaacttttggatgtagtgtggttttccttgaatatggaaaaatttgattgctattagataatctccaatggagtttatgtgttcaacttacacattcaaactttgatttagaaccatcaagttatgctttatctagttagggggttagtttctatagtgattaatggttgccttagtgtgcaaagagttgaaatttctgagtattgagccgcaaaatgaaagccattgcgcagcgaagaacctcatgctgtctgtaacggctggagtagctcagttggctcactgatttgcattgcttgtctaatttcagctagttcttcactgtgctttatcatcaagtgatgagacactgttgctaagctaatttccttgaatttctaatacgttgcttgtcacttagggaaaagtaagatttactaaacaaattcagttgcttctttcccactgatttggatagtgatggattcccatgatgtgtgattggtttattcaattttccagtctaattttaatctagtttttatgtgtgtgtagaaatatgttaaacaagattatgcatgactatgagctcgtatgtatgtatgaaggtatgtttctattttgaacatcacaacaagaaaaaggaaaagaatgcctctaagggtgccgcctcttgaacgactatgtgctctagtctacctaaatttaatgaaaagaaacaaacttaaattcccaagaattattgttcacgtacaatggagagactcatgaattgagaccggatgatatgttttcctcagataacttcttcctcataaaatagtacgaggacgattaaatttaaatggttccttatgttatgactaagttaaatgttttgtcatgtagaagaaatcattaatactaaatctccttagtttatttttatttcagataagcaagattgataacatggttctccgactccgattcaagtgttattttgatttatttgcttgtagttaattatgtacatggaaacttgggaaatgtcatttgtaggttttatgtaaatatttttagcgtgtgcataacttattaatcttttcttatataaattttggtctagtattgagatttgagaagtaaatgaatacccttatgacatatatgtgtgttggttcgcagttagctaagcagttagcatgaaaagattgtactgtgagattgcctattgcaatttccttttactagatattatatgaagttcctggtggcttttgtgaaactatgatatagcctatatttattgaattgaaaagttgctaaaactggtgtttttttaatattgagaatgccatggtagtcgtgttattaattttgttgcatctgtttacaggttgatgtgattgttacaactacaggtggtatcgaagaagatctcataaagtgccttgcacctacatataaaggagatttctctttgcctggagctcatcttcgctcaaaaggattgaatcgaattggtaatttattggtccctaatgacaattattgcaaattcgaggactggattattcctatttttgatcaaatgttgagggaacaaaataatgaggtattttattttatacttctcctgctttacaaaatttaaatggtcagtttttgtcaatgcctgaagtcacatttattggtcatgctaaattttgtagaatacattttttctgctggagaaacaacctgtttagaaggacagaagaggttctttttcagttttcacctgaaacttttttccctgtcacttcatcttccttttattgcagaatgttctgtggacaccgtccaagctaatagctcgattgggaaaagaaattaacgacgaaagctcctacctttactgggcatacaaggcaagaatgggatcaatattagattttctgcaaaacatgttattctctacttcatttctgattcaaatctttacacttgtttctttttccatcattatactgtcgaattcctacatatcctgcattgtgttacatacaggattcaacatggttatttgtgttctcttatttacttaataagtgtcagaaagttgcacataatataatattattgatactttttttgatgttttacagaataatattccagttttttgtcctggattaactgatggctcattgggtgacatgctgtacttccattccttccacaaccctggtctgattgtggacatagtgcgaggtactctttattttttactctttactgaatgttttgaaacaactggaatcatagcgaaaatgattggcaatgcaacagatataagggctgtgaatggtgaagctgtacatgcaaatcctaggaagacaggcataattattttaggaggtggtcttccaaaacatcacatttgcaatgccaatatgatgcgcaatggggcagactatgcggtttttattaacactgctcaagaatttgatggaagtgattctggagctcgtccagatgaggctgtttcatgggggaaaatacgaggatcagctaaaactgttaaggtgcatcctatatagtttcactacttgttctcgtcatttgtcagaatactctaaacttttgccttactatatcccttaaaactaaatatatttttttccactaaaccaggtacattgtgatgcaacaatagctttccctcttctggttgctgaaacatttgcctcaaaaacgaaacgtcaccattgataaaggtttactgtcaaagttcatttgaaatgtattgtgtctgagggaaatggattttctccatttcttctctccagactccggtactaaagtttagtggtgattctgagtggataaattatatttggacttgcccaatgtcacaaggtaataattatattttcaaaactctagtagtagaagaaatggagaaaaagagaaatggagaggatccaatgttgtgtttgaggatcttgatggaccagtttgccattgacatttaattttatcatgttattcttaaggtctacttagcaggcatcttttaccattcaaacgggtaatggtcacgaattgtacatgtaaaatatgtaatgatattatttttggagatgtggtttcttagttttgaggcgttgaaaattgtaatatcttgaggaaataagactagataagtttatgaacttactgctcatttatagaattttcaatatttttcaa

SEQ ID NO: 155 - DNA, 366 bp, Cicer arietinum
  misc_feature: exon 1
ctggttcctttagatcgcgtgcgactcagagagagaacatactgaaaacagtgaacaacctcaaacgccgccgccgtaagataaaatagcaattcgaagcgaaggaaaaaggtaaagtattgaggtagtgtttgtgtattgaaaaagtcaacgataatgagtgagtcaaagcaagatgacatagttatggcatcagttcactccacagtcttcaaagaatcagaaagcctcgatggaacgtgtctccaaattaaaggttacgatttcaacaacggcgtcaattatcaacaacttctcaattccatgctcactactggatttcaagcttcaaaccttgctgatgccattaacgtcgttaatcaaatg

SEQ ID NO: 156 - DNA, 95 bp, Cicer arietinum
  misc_feature: intron 1
gttcttttctaatacactccattctctttcttttttcacatgttctcactttatgcttatttattttttaatctttttggaacatggggttgaag

SEQ ID NO: 157 - DNA, 168 bp, Cicer arietinum
  misc_feature: exon 2
ctagattggaggctggttgatgaacctgtgactgaggattgtgctgacgaagagagagatttggattacagaaaatctgttaagtgtaaagtgtttttgggtttcacttctaatctcatttcatctggtgttagagatgttgttcgttacctttgtcagcatcacatg

SEQ ID NO: 158 - DNA, 1906 bp, Cicer arietinum
  misc_feature: intron 2
gtgagtgtctaatcacacctacttgctttattgattttacattttcttagctattaatttaaggatgaaagatgtacccctctgtctcacataagtgtcgttttagatattttctactttaacttctctataaaaacttaccagctgataaatatttttgttgttagttgttgtaagtaaacaatttgcaattaactcaaactcattctaattaagaatttgtgataaactacaagctaatctaaatggccatattgtcagcataaagtttaacttacttctatgttttctaaattgaaaatatatgttaggattagtgtaaagaatttaggaagaagattgttttgtaaaaccaaagacttataaagagttatttgcattgaaggtttctggaggtggattttgttttgggtataatgataggttttggtttttaggatatgtacattttgaacgcagataattttgatgattggttagttttagggttcagatatgagtgaaagtaatgaattttagcctacttgataccctaatatcttaatatttgaacttttggatgtagtgtggttttccttgaatatggaaaaatttgattgctattagataatctccaatggagtttatgtgttcaacttacacattcaaactttgatttagaaccatcaagttatgctttatctagttagggggttagtttctatagtgattaatggttgccttagtgtgcaaagagttgaaatttctgagtattgagccgcaaaatgaaagccattgcgcagcgaagaacctcatgctgtctgtaacggctggagtagctcagttggctcactgatttgcattgcttgtctaatttcagctagttcttcactgtgctttatcatcaagtgatgagacactgttgctaagctaatttccttgaatttctaatacgttgcttgtcacttagggaaaagtaagatttactaaacaaattcagttgcttctttcccactgatttggatagtgatggattcccatgatgtgtgattggtttattcaattttccagtctaattttaatctagtttttatgtgtgtgtagaaatatgttaaacaagattatgcatgactatgagctcgtatgtatgtatgaaggtatgtttctattttgaacatcacaacaagaaaaaggaaaagaatgcctctaagggtgccgcctcttgaacgactatgtgctctagtctacctaaatttaatgaaaagaaacaaacttaaattcccaagaattattgttcacgtacaatggagagactcatgaattgagaccggatgatatgttttcctcagataacttcttcctcataaaatagtacgaggacgattaaatttaaatggttccttatgttatgactaagttaaatgttttgtcatgtagaagaaatcattaatactaaatctccttagtttatttttatttcagataagcaagattgataacatggttctccgactccgattcaagtgttattttgatttatttgcttgtagttaattatgtacatggaaacttgggaaatgtcatttgtaggttttatgtaaatatttttagcgtgtgcataacttattaatcttttcttatataaattttggtctagtattgagatttgagaagtaaatgaatacccttatgacatatatgtgtgttggttcgcagttagctaagcagttagcatgaaaagattgtactgtgagattgcctattgcaatttccttttactagatattatatgaagttcctggtggcttttgtgaaactatgatatagcctatatttattgaattgaaaagttgctaaaactggtgtttttttaatattgagaatgccatggtagtcgtgttattaattttgttgcatctgtttacag

SEQ ID NO: 159 - DNA, 219 bp, Cicer arietinum
  misc_feature: exon 3
gttgatgtgattgttacaactacaggtggtatcgaagaagatctcataaagtgccttgcacctacatataaaggagatttctctttgcctggagctcatcttcgctcaaaaggattgaatcgaattggtaatttattggtccctaatgacaattattgcaaattcgaggactggattattcctatttttgatcaaatgttgagggaacaaaataatgag

SEQ ID NO: 160 - DNA, 208 bp, Cicer arietinum
  misc_feature: intron 3
gtattttattttatacttctcctgctttacaaaatttaaatggtcagtttttgtcaatgcctgaagtcacatttattggtcatgctaaattttgtagaatacattttttctgctggagaaacaacctgtttagaaggacagaagaggttctttttcagttttcacctgaaacttttttccctgtcacttcatcttccttttattgcag

SEQ ID NO: 161 - DNA, 87 bp, Cicer arietinum
  misc_feature: exon 4
aatgttctgtggacaccgtccaagctaatagctcgattgggaaaagaaattaacgacgaaagctcctacctttactgggcatacaag

SEQ ID NO: 162 - DNA, 237 bp, Cicer arietinum
  misc_feature: intron 4
gcaagaatgggatcaatattagattttctgcaaaacatgttattctctacttcatttctgattcaaatctttacacttgtttctttttccatcattatactgtcgaattcctacatatcctgcattgtgttacatacaggattcaacatggttatttgtgttctcttatttacttaataagtgtcagaaagttgcacataatataatattattgatactttttttgatgttttacag

SEQ ID NO: 163 - DNA, 106 bp, Cicer arietinum
  misc_feature: exon 5
aataatattccagttttttgtcctggattaactgatggctcattgggtgacatgctgtacttccattccttccacaaccctggtctgattgtggacatagtgcgag

SEQ ID NO: 164 - DNA, 78 bp, Cicer arietinum
  misc_feature: intron 5
gtactctttattttttactctttactgaatgttttgaaacaactggaatcatagcgaaaatgattggcaatgcaacag

SEQ ID NO: 165 - DNA, 236 bp, Cicer arietinum
  misc_feature: exon 6
atataagggctgtgaatggtgaagctgtacatgcaaatcctaggaagacaggcataattattttaggaggtggtcttccaaaacatcacatttgcaatgccaatatgatgcgcaatggggcagactatgcggtttttattaacactgctcaagaatttgatggaagtgattctggagctcgtccagatgaggctgtttcatgggggaaaatacgaggatcagctaaaactgttaag

SEQ ID NO: 166 - DNA, 109 bp, Cicer arietinum
  misc_feature: intron 6
gtgcatcctatatagtttcactacttgttctcgtcatttgtcagaatactctaaacttttgccttactatatcccttaaaactaaatatatttttttccactaaaccag

SEQ ID NO: 167 - DNA, 558 bp, Cicer arietinum
  misc_feature: exon 7
gtacattgtgatgcaacaatagctttccctcttctggttgctgaaacatttgcctcaaaaacgaaacgtcaccattgataaaggtttactgtcaaagttcatttgaaatgtattgtgtctgagggaaatggattttctccatttcttctctccagactccggtactaaagtttagtggtgattctgagtggataaattatatttggacttgcccaatgtcacaaggtaataattatattttcaaaactctagtagtagaagaaatggagaaaaagagaaatggagaggatccaatgttgtgtttgaggatcttgatggaccagtttgccattgacatttaattttatcatgttattcttaaggtctacttagcaggcatcttttaccattcaaacgggtaatggtcacgaattgtacatgtaaaatatgtaatgatattatttttggagatgtggtttcttagttttgaggcgttgaaaattgtaatatcttgaggaaataagactagataagtttatgaacttactgctcatttatagaattttcaatatttttcaa

SEQ ID NO: 168 - DNA, 3615 bp, Coffea canephora
ttactttttgagtggtgataatcaacaaagcagaggatgggcgacgccttgaatggcggaaaccccttggagtccgcccgcttagcagcttttaagcagtcagaaaccctagaaggaacttgccccgtaatccagggctatgatttcaaccaaggcgtcaactatccggagcttctcaaatcaatggtctccactggttttcaagcctccaatctcggtgacgccattgacgtagttaaccaaatggtcagtcactcgaatccaggatgtattaattgattaaccggatgatcactcgcctttttctgtttgattttgagttcttcgtatttcagttgtcaaaaggttcgatcttgtttgagtttttagttactatttcatgaagcgcttaggtaggccgaaatgttattggttttaagtacgtgctgcttgctgacaacttaggatggaaatgccctgaaatgagggtgtcttttttgtttcaacatccagttgtctattttaatttttgctgtcaatgtttgtgtttgattttcggtataatggattaaagctggattggaggctttcagacgagtgtccaacggaggattgcagtgaagaggagagagatccagcatttagagagtcagttaggtgtaaagttttccttggattcacttcaaatcttgtatcttctggggttcgagacaccattcggtatcttgttcagcatcacatggtgagcagttgtgtaaatatcacttctgattgtgctttggccagtttgtattctgctaggactgattgtctctaggcattactctctgtgatgattcaggacgtcgggtaggtaaatggactttgtagaagttgctatttagttaagagacacaaaggttgaccttaaacttaggtgatatgcataattgctggaatcatgtgctattctgcttatttagtaaaggatacttgacatttctggctctggaatagactcatacgtaccttattggttacttatgggttggtttctcacttaatcttagtcaccttaaacactgtctgcattcatctttactggtaaatgcattcatctttactgactttaccagtttatagttggatgatgttattaaatcaactaggagaacaatttccactgtcatagagtcagataaggtatggagtagtttatattagattagttggatgtacttgttccgcattaattgatgggtgggtgatgattgtttatgtaatagggtgctgcaaatgttttgttagttgatttttttggtctccttttcctgcttcgtttaaatttgattttcaaaggtgaatgtttgaaaattgtaatgcaggttgatgtagttgttacaacagctggtggtgtggaagaggatctcatcaagtgccttgcacccacatataaaggtgacttctctttgcctggagctgctttacgctcgaaagggttgaatcgtattggtaacttgttggttcctaataacaattactgcaaatttgaggactggattattccaatttttgacaagatgttggaagagcagacttcaaaggtatccttgtatgtccctctttgttttgttttactaatttggtgttgttgtagcttaattcttgcatcagaattggtttgggtccatcttagtgtcactggcatttgacaaattggttttggatctaattgtactttaaatagcatgctgtagttttgaagctgtaagcataaaagcgcaaatgatgcgtgctagccactccaaggatcaagattgcaaggctgtatactgtcattttggtatcaaaatttcattgttttgggatagcttatggtactggatgccatgccatccattggctgctttaagatgataaaattttggtggattactcttagatgtcttgaatgattgcagatttgtattagccttacttgtgcttgtaaaattcaatatccttttctgttgttttccctctctagtgggagagcaaatttgtgttgatggagaaaagcataaaaaataatatatcatgagctttccttatcttcttgcagaatatgctgtggacgccatctaaagtgatctcccgccttggaaaagaaattaacgatgagagttcatatttgtactgggcctacaaggtaggtattcaatcagactactcgtttttttgtgtcaaatggttctcaatttgagttgtcatgctgtgtaatctagcttgtccattttttgataaaagaatttgaagaacagttataaaattgccaaacacgagaactttctgtttattcatggcatgaatagctttatcccattcagtgcttatcaatttatgtattttgtttttgtagttatggagtactgtgatgaacaatatcattatgatgctaagaggaaaaataaatagtgatatggttgcaatatctgcttactgattctaaaatctccatttattttcagaacaacattcctgtcttttgtcctggcttaacagatggctcactgggtgacatgctatatttccattctttccgcaatcctggcctggttattgacattgtgcagggtaacaacatatcattctcattttctgccaaggcatagtacttctggtaacaatttggtgaaatgttataatcgcaagcagatattaggaacatgaacggcgaggctgtccatgtcggtctcaggaagacaggaatgataattcttggagggggactacccaagcatcatatatgtaatgcaaatatgatgcgtaatggtgcagactttgctgtttttattaacacagcacaagaatacgatggaagtgattctggtgcccgtccagatgaagctgtatcatggggaaagatacgaggttctgcgaaggctgtgaaggttaattcttttggagttgtacattttttagtcctttgcttttgtctgcattctcagatgccttgaggcttgctatcagctaagttttgagattagatcaagtcttattttcacattaaaacaaaagttcaattactaccttctagttattacttgtttgatgagataattagtagaaagtaaaatctgtatatttttgtcacattacaatttgtttcttttagcaggttcactgtgatgcaacgattgcctttcctctccttgtagcagaaacctttgctacaaaagtcaaataacgttgtatgggatgaagttttaaaatgataatgcagctgcggtggatagctaatgattggtcccggtaaatttgatgatgctatttggcacgtcaagttccactcctttgttcaatgctgtttttctaggtggcgcattataaattgcattccggttgtgatgaaatactacattggaaaggaaatacaacgccagcaacaagttccattgtaattcttcagcttctggtaactttgatgctcaagaggaatagatacgtgctgtatttcatttccattcttttactttagaatgaccataggagtccatgaacctcacattttgtgatttaggcagatctgaattgtatctttaggcgaggagagttttaggttgcccaacttattagtgcagataaagcaaaaaaaagttcccagattccacttcccct

SEQ ID NO: 169 - DNA, 246 bp, Coffea canephora
  misc_feature: exon 1
ttactttttgagtggtgataatcaacaaagcagaggatgggcgacgccttgaatggcggaaaccccttggagtccgcccgcttagcagcttttaagcagtcagaaaccctagaaggaacttgccccgtaatccagggctatgatttcaaccaaggcgtcaactatccggagcttctcaaatcaatggtctccactggttttcaagcctccaatctcggtgacgccattgacgtagttaaccaaatg

SEQ ID NO: 170 - DNA, 307 bp, Coffea canephora
  misc_feature: intron 1
gtcagtcactcgaatccaggatgtattaattgattaaccggatgatcactcgcctttttctgtttgattttgagttcttcgtatttcagttgtcaaaaggttcgatcttgtttgagtttttagttactatttcatgaagcgcttaggtaggccgaaatgttattggttttaagtacgtgctgcttgctgacaacttaggatggaaatgccctgaaatgagggtgtcttttttgtttcaacatccagttgtctattttaatttttgctgtcaatgtttgtgtttgattttcggtataatggattaaag

SEQ ID NO: 171 - DNA, 168 bp, Coffea canephora
  misc_feature: exon 2
ctggattggaggctttcagacgagtgtccaacggaggattgcagtgaagaggagagagatccagcatttagagagtcagttaggtgtaaagttttccttggattcacttcaaatcttgtatcttctggggttcgagacaccattcggtatcttgttcagcatcacatg

SEQ ID NO: 172 - DNA, 622 bp, Coffea canephora
  misc_feature: intron 2
gtgagcagttgtgtaaatatcacttctgattgtgctttggccagtttgtattctgctaggactgattgtctctaggcattactctctgtgatgattcaggacgtcgggtaggtaaatggactttgtagaagttgctatttagttaagagacacaaaggttgaccttaaacttaggtgatatgcataattgctggaatcatgtgctattctgcttatttagtaaaggatacttgacatttctggctctggaatagactcatacgtaccttattggttacttatgggttggtttctcacttaatcttagtcaccttaaacactgtctgcattcatctttactggtaaatgcattcatctttactgactttaccagtttatagttggatgatgttattaaatcaactaggagaacaatttccactgtcatagagtcagataaggtatggagtagtttatattagattagttggatgtacttgttccgcattaattgatgggtgggtgatgattgtttatgtaatagggtgctgcaaatgttttgttagttgatttttttggtctccttttcctgcttcgtttaaatttgattttcaaaggtgaatgtttgaaaattgtaatgcag

SEQ ID NO: 173 - DNA, 219 bp, Coffea canephora
  misc_feature: exon 3
gttgatgtagttgttacaacagctggtggtgtggaagaggatctcatcaagtgccttgcacccacatataaaggtgacttctctttgcctggagctgctttacgctcgaaagggttgaatcgtattggtaacttgttggttcctaataacaattactgcaaatttgaggactggattattccaatttttgacaagatgttggaagagcagacttcaaag

SEQ ID NO: 174 - DNA, 497 bp, Coffea canephora
  misc_feature: intron 3
gtatccttgtatgtccctctttgttttgttttactaatttggtgttgttgtagcttaattcttgcatcagaattggtttgggtccatcttagtgtcactggcatttgacaaattggttttggatctaattgtactttaaatagcatgctgtagttttgaagctgtaagcataaaagcgcaaatgatgcgtgctagccactccaaggatcaagattgcaaggctgtatactgtcattttggtatcaaaatttcattgttttgggatagcttatggtactggatgccatgccatccattggctgctttaagatgataaaattttggtggattactcttagatgtcttgaatgattgcagatttgtattagccttacttgtgcttgtaaaattcaatatccttttctgttgttttccctctctagtgggagagcaaatttgtgttgatggagaaaagcataaaaaataatatatcatgagctttccttatcttcttgcag

SEQ ID NO: 175 - DNA, 87 bp, Coffea canephora
  misc_feature: exon 4
aatatgctgtggacgccatctaaagtgatctcccgccttggaaaagaaattaacgatgagagttcatatttgtactgggcctacaag

SEQ ID NO: 176 - DNA, 319 bp, Coffea canephora
  misc_feature: intron 4
gtaggtattcaatcagactactcgtttttttgtgtcaaatggttctcaatttgagttgtcatgctgtgtaatctagcttgtccattttttgataaaagaatttgaagaacagttataaaattgccaaacacgagaactttctgtttattcatggcatgaatagctttatcccattcagtgcttatcaatttatgtattttgtttttgtagttatggagtactgtgatgaacaatatcattatgatgctaagaggaaaaataaatagtgatatggttgcaatatctgcttactgattctaaaatctccatttattttcag

SEQ ID NO: 177 - DNA, 106 bp, Coffea canephora
  misc_feature: exon 5
aacaacattcctgtcttttgtcctggcttaacagatggctcactgggtgacatgctatatttccattctttccgcaatcctggcctggttattgacattgtgcagg

SEQ ID NO: 178 - DNA, 81 bp, Coffea canephora
  misc_feature: intron 5
gtaacaacatatcattctcattttctgccaaggcatagtacttctggtaacaatttggtgaaatgttataatcgcaagcag

SEQ ID NO: 179 - DNA, 236 bp, Coffea canephora
  misc_feature: exon 6
atattaggaacatgaacggcgaggctgtccatgtcggtctcaggaagacaggaatgataattcttggagggggactacccaagcatcatatatgtaatgcaaatatgatgcgtaatggtgcagactttgctgtttttattaacacagcacaagaatacgatggaagtgattctggtgcccgtccagatgaagctgtatcatggggaaagatacgaggttctgcgaaggctgtgaag

SEQ ID NO: 180 - DNA, 227 bp, Coffea canephora
  misc_feature: intron 6
gttaattcttttggagttgtacattttttagtcctttgcttttgtctgcattctcagatgccttgaggcttgctatcagctaagttttgagattagatcaagtcttattttcacattaaaacaaaagttcaattactaccttctagttattacttgtttgatgagataattagtagaaagtaaaatctgtatatttttgtcacattacaatttgtttcttttagcag

SEQ ID NO: 181 - DNA, 500 bp, Coffea canephora
  misc_feature: exon 7
gttcactgtgatgcaacgattgcctttcctctccttgtagcagaaacctttgctacaaaagtcaaataacgttgtatgggatgaagttttaaaatgataatgcagctgcggtggatagctaatgattggtcccggtaaatttgatgatgctatttggcacgtcaagttccactcctttgttcaatgctgtttttctaggtggcgcattataaattgcattccggttgtgatgaaatactacattggaaaggaaatacaacgccagcaacaagttccattgtaattcttcagcttctggtaactttgatgctcaagaggaatagatacgtgctgtatttcatttccattcttttactttagaatgaccataggagtccatgaacctcacattttgtgatttaggcagatctgaattgtatctttaggcgaggagagttttaggttgcccaacttattagtgcagataaagcaaaaaaaagttcccagattccacttcccct

SEQ ID NO: 182 - DNA, 2208 bp, Camelina sativa
agcaaaaagattcgtttgaagatggtcatcttttattccgtttaatctagaaccctagaacacccccaaaaacccttccagatccagcgaaatcgattttggtcttggagcaaagatggaggatcgtgttttctcttcggttcactcaacggttttcaaagaatccgaatcgctagaagggaagtgtgacaaaatcgaaggatacgatttcaatgagggagtaaattacccaaagcttatgcgatccatgctcaccactggctttcaagcctcaaatctcggcgaagctattgacgtcgtcaatcaaatggttttttatttgctcccttcgattctcgatttaacctaaaataaagttttctccttttttaattcgttttgcgtgaattagttattaacagagggtttgaattgttattgaagctagactggagactggctgatgaaaccacagtagctgaagactgtagtgaagaggagaaagacccatcttatagagagtctgtgaaatgtaaaatctttcttggtttcacttcgaatcttgtttcatctggtgttagagacactattcgatatcttgttcagcatcatatggttagtggtaacactgtttatagatgttaaattatccggctttagtttgattagcttagatttctgtcttttagttgtttggttctaatgcttttttttttgtttttgcaggttgatgttatagtcactacaactggtggcgtagaggaagatctcatcaaatgccttgcacctacatttaaaggtgatttctctctacctggcgcttatctacggtctaagggattgaaccgaattgggaacttgctggttcctaatgataactactgcaagtttgaggattggatcattcccatctttgacgagatgttgaaggaacagaaagaagaggtattactcaaatcttttttcattctatatcaaagaggaagattagattttgctttctctcttgtatcataactttgtttatgaatttttctttctctggatttttccttgtagaatgtgttgtggacaccttctaaactgttagcacgacttggaaaagaaataaacaatgagagttcatacctttattgggcatacaaggtaaccaaatttttttacccttcctagtattttaggcatcctgttaggtaaggaactcagggattaattttttctgcctcttgtggttggtgtatatgtagatgaatattccagtattctgcccggggttaacagatggctctcttggcgatatgctgtattttcactcctttcgtacctctggccttgtcattgatgtagtgcaaggtacttctttcactcaatgaggcaggcaatgtcatagagttttcatgttagtctagtgcaagactattgtaagtagcagtaaattgtagctttttcagttcagtaacagacgttacagttacttgatagctaaagctttaatcggaagctaggagaattagggcaatatggttttgtgtttggagatgggtcaagactcttgtctctagagttagagaatcttatcataatgtttcatggtggattgtaagaaattggttaatgttttatatacacacagatatcagggctatgaatagtgaagctgtccatgcaagtccaagaaagacagggatgataatccttggagggggcataccgaagcaccacatatgtaatgccaatatgatgcgtaacggtgcagattacgccgtgttcataaacaccgggcaggaatttgatgggagcgactcgggtgcacgccctgatgaagccgtatcttggggtaaaataaggggatctgctaaaaccgtgaaggtcggattcaagcctgccttcttatttcttcacaacctaactaagttctctcgctcaatggttctgagtatgatattggatcgtttcttgcaggtgtactgtgatgctaccatagctttccctttgttggtggccgaaacatttgccacaaagagagaacaaacctgtgagtctaaaacgtaaagaactgactgtcgtttaggccagtaaaacactccacattgatgaaatagtacccataaaacactgtggctgtgacccaaattgtcgccttgcagaatgtactttattgtttgctctgattttaaaatgattaagattgtctttgattgattaaacacacaagagttttgtggtcaa

SEQ ID NO: 183 - DNA, 310 bp, Camelina sativa
  misc_feature: exon 1
agcaaaaagattcgtttgaagatggtcatcttttattccgtttaatctagaaccctagaacacccccaaaaacccttccagatccagcgaaatcgattttggtcttggagcaaagatggaggatcgtgttttctcttcggttcactcaacggttttcaaagaatccgaatcgctagaagggaagtgtgacaaaatcgaaggatacgatttcaatgagggagtaaattacccaaagcttatgcgatccatgctcaccactggctttcaagcctcaaatctcggcgaagctattgacgtcgtcaatcaaatg

SEQ ID NO: 184 - DNA, 113 bp, Camelina sativa
  misc_feature: intron 1
gttttttatttgctcccttcgattctcgatttaacctaaaataaagttttctccttttttaattcgttttgcgtgaattagttattaacagagggtttgaattgttattgaag

SEQ ID NO: 185 - DNA, 171 bp, Camelina sativa
  misc_feature: exon 2
ctagactggagactggctgatgaaaccacagtagctgaagactgtagtgaagaggagaaagacccatcttatagagagtctgtgaaatgtaaaatctttcttggtttcacttcgaatcttgtttcatctggtgttagagacactattcgatatcttgttcagcatcatatg

SEQ ID NO: 186 - DNA, 111 bp, Camelina sativa
  misc_feature: intron 2
gttagtggtaacactgtttatagatgttaaattatccggctttagtttgattagcttagatttctgtcttttagttgtttggttctaatgcttttttttttgtttttgcag

SEQ ID NO: 187 - DNA, 219 bp, Camelina sativa
  misc_feature: exon 3
gttgatgttatagtcactacaactggtggcgtagaggaagatctcatcaaatgccttgcacctacatttaaaggtgatttctctctacctggcgcttatctacggtctaagggattgaaccgaattgggaacttgctggttcctaatgataactactgcaagtttgaggattggatcattcccatctttgacgagatgttgaaggaacagaaagaagag

SEQ ID NO: 188 - DNA, 114 bp, Camelina sativa
  misc_feature: intron 3
gtattactcaaatcttttttcattctatatcaaagaggaagattagattttgctttctctcttgtatcataactttgtttatgaatttttctttctctggatttttccttgtag

SEQ ID NO: 189 - DNA, 87 bp, Camelina sativa
  misc_feature: exon 4
aatgtgttgtggacaccttctaaactgttagcacgacttggaaaagaaataaacaatgagagttcatacctttattgggcatacaag

SEQ ID NO: 190 - DNA, 101 bp, Camelina sativa
  misc_feature: intron 4
gtaaccaaatttttttacccttcctagtattttaggcatcctgttaggtaaggaactcagggattaattttttctgcctcttgtggttggtgtatatgtag

SEQ ID NO: 191 - DNA, 106 bp, Camelina sativa
  misc_feature: exon 5
atgaatattccagtattctgcccggggttaacagatggctctcttggcgatatgctgtattttcactcctttcgtacctctggccttgtcattgatgtagtgcaag

SEQ ID NO: 192 - DNA, 280 bp, Camelina sativa
  misc_feature: intron 5
gtacttctttcactcaatgaggcaggcaatgtcatagagttttcatgttagtctagtgcaagactattgtaagtagcagtaaattgtagctttttcagttcagtaacagacgttacagttacttgatagctaaagctttaatcggaagctaggagaattagggcaatatggttttgtgtttggagatgggtcaagactcttgtctctagagttagagaatcttatcataatgtttcatggtggattgtaagaaattggttaatgttttatatacacacag

SEQ ID NO: 193 - DNA, 236 bp, Camelina sativa
  misc_feature: exon 6
atatcagggctatgaatagtgaagctgtccatgcaagtccaagaaagacagggatgataatccttggagggggcataccgaagcaccacatatgtaatgccaatatgatgcgtaacggtgcagattacgccgtgttcataaacaccgggcaggaatttgatgggagcgactcgggtgcacgccctgatgaagccgtatcttggggtaaaataaggggatctgctaaaaccgtgaag

SEQ ID NO: 194 - DNA, 93 bp, Camelina sativa
  misc_feature: intron 6
gtcggattcaagcctgccttcttatttcttcacaacctaactaagttctctcgctcaatggttctgagtatgatattggatcgtttcttgcag

SEQ ID NO: 195 - DNA, 267 bp, Camelina sativa
  misc_feature: exon 7
gtgtactgtgatgctaccatagctttccctttgttggtggccgaaacatttgccacaaagagagaacaaacctgtgagtctaaaacgtaaagaactgactgtcgtttaggccagtaaaacactccacattgatgaaatagtacccataaaacactgtggctgtgacccaaattgtcgccttgcagaatgtactttattgtttgctctgattttaaaatgattaagattgtctttgattgattaaacacacaagagttttgtggtcaa

SEQ ID NO: 196 - DNA, 6397 bp, Camellia sinensis
  misc_feature (4275)..(4275): n is a, c, g, or t
atgggggaagaagacatggaagaacgtcttttggattccgtacgctcagtagttttcaaagaatcagagactctcgaaggatcttgtattaagatccaaggctatgatttcaaccgaggcgtcaactattctgagcttcttaaatccatggtctcaactgggtttcaagccaccaatctcggcgatgccattgaagttgtcaatcaaatggtgggttcgatttccaaaacccccaatttttttgatttttttttttttcaaattatgtatgttatttatgtttggacttttgggtttttgattgggggtttgaagctagactggaggctttcctacgagtctttgacggaggactgcggcgaagaggagagaaacccggcatacagagagtccatgaggtgcaaggtttttctgggttttacatccaatttgatttcttctggtgttcgagacaccattcgctatcttgttcagcatcacatggtgagtgaatcatgtgtgtgtgtgcgcgcgcccaatatattttgagtggtatctatgtttaaaaagaaggcaatttgatttgcaaatgtgattgttctgtcagtttcatagttcgaaagccctcatttttgagtgaaagtagatacatgaacttaaagaagacatgtcaattctactgggtagttgttgcaacaaattagaacgtggaaactggtaattggaccaaatatcatttagacaacgttgaaatgcaattttatcttgaatatttgaacaatttgtggctctaagagcgtctccaccgtttatttagatgtttcatcaaatttaaatttgatgaaacatgccctttttttctgctccaaccgtcgcatcaaacccatatcaaatgaaggcgatgctagatttttcatcaaatcaagggaatgtttaactttttatcaaatttcatagggacaaccgggtggatgacccggcttttggaagttttgctgaaaatttgctctaggacgttcagccggctggacgactgaccagattagatgaaatgattggagcgcaatatatctgatcaaacttttactcaaatttgataaaaatttgagtaagcgttggagatgcgctaagagaatctccaaccttcactactttttttcatctaatttgattccaagtttgagtaaaatgtttgatttgatatgaactaccctaatttaactctttcatcaaaatctttttaaaaatttccctcttatcccaaattttccttttcatcaaatttgatggaaaaaaaaaaaaaaaaaaactccaatgctttaatttttaatttttcttcaaatttaaatttgatgaaagatttgttgaattctcaatttgatgaaaaaaatagttcttccttgatttgataaatatttgatgaaaggattgaaaatggtttttgagcgctacgaattgtttttgtaataaacctttcattaatttgaaaaggtagagtggataggagtagtattgatagaagataagttgagagaaaatagattgagatggtatgatcgtatacaacggagaccaacagagacaatagtaaagagatgcgatacagtgatggttgatgaaagtgttagaggaatgggcaaatctagattgacgtgggctagtgtagtaaatagagatatgaacaaaatggctttggatagagtcgagtggagaagaaggattcatgtaactgatcccatttgatggaacttaaggctttgtttggtttggtttggttatttgtaattgcacatttttgcatctattacatgtctagatcattactcagaaagttagaaatttttacccagttatgtcactcaagctgttatctgtttgtaggttgatgtagttgttacaacagctggtggtgttgaagaagaccttataaaatgcctcgcaccgacatataaaggcgatttttctttacctggagctcatttacgttcaaaaggattgaaccgcattggtaacttgttggttcccaatgagaactactgcaaatttgaggattggatcattccaatatttgaccagatgttggaagagcagactgcgaaggtattactatttactttttttactttgattgtgtgcatacttaacagttggcttaccatgaacgttcctaatatatatgtatttaatttttatattttcccacgtagttggcttgctagttgcaaacttgtagcagtgctgtcctcaaaatttaccatgactggatgcaatgctaatattgctctttcatcctttggagcagtatctattacagccatgttacatacgtgctgaatatataaaagaaaaaactgatatctgaaaaaaaaaaagtgataattatctgatgaatccctttctagtgagaattgtatgtgtgatgaaatttaagtgcgtgatactttttgcggatgggtaatgatatcccattatgtaacttaagattttctcaatgctacatattttcacttgtgagcaccaatatacttttaaggttccctaagtggtgttatgtagtttataaaatgtcttgatacattatgaaatgaaacatataattttctgttcctttgacttgtccactatttgcttttaatcatgaactgctttccaaggacattggttaactttcatactacccattttcttttttaccttgcagaatgtattgtggactccatctaaagttattgctcgcttagggaaagaaataaacaatgagagttcatacctctactgggcatacaaggtagacatccaatcaatttaacctgatttttctataactaactcaaattttaaaatttattatattgtatcatggacgacatttaatatataatcaccatcatttctaagtttttgcattcgaattatatatttttttgttgttgtgtgttttgcatttgtgcaacttgctattttactgttgagatgaaaaaggtagcttggatcaaattgtaagccatgctccttggaaatgaattgttgaacaatacacactatctgattggtccaaagctctgagtttcatatccaaaaagtgtgtcgatcccatgtaaacttgtgggctccatggttttgaaccaatagttgtgtgaacaaaatcaaactccatgctcctcctacatgacgttataataattgtgtttttcttgggctgtcatcttacataggaccttgtactagcttgatttgaattctgtatgtcaagcctgaaacgactttctgtgagcatcatagattttaattgtgggtaaagaagcaagacttcctacagctgaatttagtctaagaaaggtttccggttgagttttcaaaacttgtctgctcaattgtttttcctgaaaaattagaaactaatttgacaaaaataaaaccaaaacagatattttttaaatttcaaaattatttcctctccaacagatagaaaaccacataaaaaatagtgagtttttgatttgtttttctttcatttttatcaccaaactagtttttggaatttttttagaaaaatgattttgaaaactcaaccaaacaaaggtagtaatgactattccttggtaactttccaatggaaaaatgggaatcatatttcttcattattcattctcaaaattttgattgctttctattagtaagctaaattctaattgtatttcctgtaatacttctttgttgtggattattacaattaaggtaaaagttgacaaactatttaccatctagtcaattaaataattttttttttttttttggagtctatgtataggaaaaactatagataaaatgtcatttttattcatatcccttccttcccccattgttgccagccaaaactttctttcaccctagtgcaaattactccccttctttttctgctacagctgcaatgcccttgcctttctccttccacatctgcaacccccatccatctattgcactactgtagccccttccctcttctccttctacgatcattgtaccctttacatcaacctgccggtgtagttgaatcaacccaattcatttaattcatgtatagtgggtgtttgggaagtgggtttttatataggtttttttagttgtaggatattattggataaaaaaattttggtgtttgggaagatagttgggtttttttgtgattggatgtgatgtttgtgagagaaaaagtgaaatgattatggggttggatgtgatattttgtttggatttgttttttttagttttgtaaaatctgtcttttagtaaaanagtgaaaaaaaaaaaaaaaaaacctaggcaaaattcttgccaaacaccgccataattgttatcactccagcatccaacctgcattccatagccacaaaacctcacaaataattccttgaaactgaagcatacaagagtacaccagattattgaggtaatttgaaaatgataaatgaggtgagcttttcctcgggggtgggggggtgattaaaaggagtgacgaaactgttggtaaattttttgaaaaatgaaatgtatgatggtatcaacaagaggtgtgagacatgcaaaaagggcgaagaaaggggtatgggcaaatgacattttatttatgtttttttcctcgactgtaaaacaagtttcatatatgactttggaatattattttttaatggatttgctggtaaaaaagtgtcaatttttgcttaattataaagatcccttatcatgagaaatttgccaaaagaattggaaataaaaattcaacaaagaaattcttgttttttcatggattgcttgtccaacaagtcaagcatttgcatttgaatagtaagcaaatcttgttctttcatggatggctttgtccaacgagtcaaacatctgcatatgaataggcatttgatgatctggttcaaaaaaaaaaaagaataggcatttgatgatatgtataattgtttatctaaactattggtgtggacacacacatcaacctgctattattgtctattatataaatatgcaatttcttctaggactctgacgtggaccattgctgtaatatttttttgcttcatagaacaatattccagtcttctgccctggcttaactgacggctctttgggggatatgttatactttcattctttccgcaaccccggtctagtcgttgacgtagtgcaaggtaaagcttctcctttgtatgtcgttttcatgcccagtatacgataacttaggaaatgaattgatgaccttagctctatacatagatattagggccatgaatggtgaagctgtccatgcaagtcctaggaagactggaatgataattcttggaggtggacttcccaagcatcacatttgcaatgcgaatatgatgcgtaacggggcagattatgcagtctttattaacacagcgcaagagtttgatggtagtgattctggtgctcgtcctgatgaagctgtatcatggggaaaaatacgaggttctgctaagactgttaaggtttaactttttttccttctcttttgtgaccttgaagcttctgttattagtataacctgtgcagatctgttggccaatttgcatcttttgttaattgtttgccattttggttatttgcatgcttgtttaatcaaatcatgaatcgaatcgtgaattgttttgctaaatagtgaatcggaaattgtaagattaattatttagcataaatgtagtatcacatctcttttataggccattttgtataattgacattacattctcttatccatttgtacacttggcaattaaagattattatgcaaaattgatttgaaatctctgtttttgcttactgcttcatacatctggtatatgttgaacaatccactggattactaaagtaatgcattgatttcaatatggtttctaatagttgtactgactttggaatggaaggcccatgttcaatccttactctatggaaccaaatttcctgaaattgccgaatggctaatctaagaaaatgcttcaagttacaaaacatatttgtggttaatttatcttgtttttgttgtgcaaaaacaacactgcttcattattatgcaaacaaaattgaattgcagtgacttgaagtgaatcacaaaatcatactgaatcgcaattgaatcataagttttgctcatcagtttaagatataacagcacaagttgaatagttttggttgaaatttgtcgaatcatatgaatcgaatcgtgaatcataaagattctaacaaccatggtcatagtatgattttaattgttttcggccttttgattggttctaaccaggtacattgcgatgcgactattgcttttcctctactggttgcggaaacatttgctgcaaggggaaagagatcggccgagaacgagtcctaa

SEQ ID NO: 197 - DNA, 210 bp, Camellia sinensis
  misc_feature: exon 1
atgggggaagaagacatggaagaacgtcttttggattccgtacgctcagtagttttcaaagaatcagagactctcgaaggatcttgtattaagatccaaggctatgatttcaaccgaggcgtcaactattctgagcttcttaaatccatggtctcaactgggtttcaagccaccaatctcggcgatgccattgaagttgtcaatcaaatg

SEQ ID NO: 198 - DNA, 105 bp, Camellia sinensis
  misc_feature: intron 1
gtgggttcgatttccaaaacccccaatttttttgatttttttttttttcaaattatgtatgttatttatgtttggacttttgggtttttgattgggggtttgaag

SEQ ID NO: 199 - DNA, 168 bp, Camellia sinensis
  misc_feature: exon 2
ctagactggaggctttcctacgagtctttgacggaggactgcggcgaagaggagagaaacccggcatacagagagtccatgaggtgcaaggtttttctgggttttacatccaatttgatttcttctggtgttcgagacaccattcgctatcttgttcagcatcacatg

SEQ ID NO: 200 - DNA, 1377 bp, Camellia sinensis
  misc_feature: intron 2
gtgagtgaatcatgtgtgtgtgtgcgcgcgcccaatatattttgagtggtatctatgtttaaaaagaaggcaatttgatttgcaaatgtgattgttctgtcagtttcatagttcgaaagccctcatttttgagtgaaagtagatacatgaacttaaagaagacatgtcaattctactgggtagttgttgcaacaaattagaacgtggaaactggtaattggaccaaatatcatttagacaacgttgaaatgcaattttatcttgaatatttgaacaatttgtggctctaagagcgtctccaccgtttatttagatgtttcatcaaatttaaatttgatgaaacatgccctttttttctgctccaaccgtcgcatcaaacccatatcaaatgaaggcgatgctagatttttcatcaaatcaagggaatgtttaactttttatcaaatttcatagggacaaccgggtggatgacccggcttttggaagttttgctgaaaatttgctctaggacgttcagccggctggacgactgaccagattagatgaaatgattggagcgcaatatatctgatcaaacttttactcaaatttgataaaaatttgagtaagcgttggagatgcgctaagagaatctccaaccttcactactttttttcatctaatttgattccaagtttgagtaaaatgtttgatttgatatgaactaccctaatttaactctttcatcaaaatctttttaaaaatttccctcttatcccaaattttccttttcatcaaatttgatggaaaaaaaaaaaaaaaaaaactccaatgctttaatttttaatttttcttcaaatttaaatttgatgaaagatttgttgaattctcaatttgatgaaaaaaatagttcttccttgatttgataaatatttgatgaaaggattgaaaatggtttttgagcgctacgaattgtttttgtaataaacctttcattaatttgaaaaggtagagtggataggagtagtattgatagaagataagttgagagaaaatagattgagatggtatgatcgtatacaacggagaccaacagagacaatagtaaagagatgcgatacagtgatggttgatgaaagtgttagaggaatgggcaaatctagattgacgtgggctagtgtagtaaatagagatatgaacaaaatggctttggatagagtcgagtggagaagaaggattcatgtaactgatcccatttgatggaacttaaggctttgtttggtttggtttggttatttgtaattgcacatttttgcatctattacatgtctagatcattactcagaaagttagaaatttttacccagttatgtcactcaagctgttatctgtttgtag

SEQ ID NO: 201 - DNA, 219 bp, Camellia sinensis
  misc_feature: exon 3
gttgatgtagttgttacaacagctggtggtgttgaagaagaccttataaaatgcctcgcaccgacatataaaggcgatttttctttacctggagctcatttacgttcaaaaggattgaaccgcattggtaacttgttggttcccaatgagaactactgcaaatttgaggattggatcattccaatatttgaccagatgttggaagagcagactgcgaag

SEQ ID NO: 202 - DNA, 601 bp, Camellia sinensis
  misc_feature: intron 3
gtattactatttactttttttactttgattgtgtgcatacttaacagttggcttaccatgaacgttcctaatatatatgtatttaatttttatattttcccacgtagttggcttgctagttgcaaacttgtagcagtgctgtcctcaaaatttaccatgactggatgcaatgctaatattgctctttcatcctttggagcagtatctattacagccatgttacatacgtgctgaatatataaaagaaaaaactgatatctgaaaaaaaaaaagtgataattatctgatgaatccctttctagtgagaattgtatgtgtgatgaaatttaagtgcgtgatactttttgcggatgggtaatgatatcccattatgtaacttaagattttctcaatgctacatattttcacttgtgagcaccaatatacttttaaggttccctaagtggtgttatgtagtttataaaatgtcttgatacattatgaaatgaaacatataattttctgttcctttgacttgtccactatttgcttttaatcatgaactgctttccaaggacattggttaactttcatactacccattttcttttttaccttgcag

SEQ ID NO: 203 - DNA, 87 bp, Camellia sinensis
  misc_feature: exon 4
aatgtattgtggactccatctaaagttattgctcgcttagggaaagaaataaacaatgagagttcatacctctactgggcatacaag

SEQ ID NO: 204 - DNA, 2304 bp, Camellia sinensis
  misc_feature: intron 4
  misc_feature (1508)..(1508): n is a, c, g, or t
gtagacatccaatcaatttaacctgatttttctataactaactcaaattttaaaatttattatattgtatcatggacgacatttaatatataatcaccatcatttctaagtttttgcattcgaattatatatttttttgttgttgtgtgttttgcatttgtgcaacttgctattttactgttgagatgaaaaaggtagcttggatcaaattgtaagccatgctccttggaaatgaattgttgaacaatacacactatctgattggtccaaagctctgagtttcatatccaaaaagtgtgtcgatcccatgtaaacttgtgggctccatggttttgaaccaatagttgtgtgaacaaaatcaaactccatgctcctcctacatgacgttataataattgtgtttttcttgggctgtcatcttacataggaccttgtactagcttgatttgaattctgtatgtcaagcctgaaacgactttctgtgagcatcatagattttaattgtgggtaaagaagcaagacttcctacagctgaatttagtctaagaaaggtttccggttgagttttcaaaacttgtctgctcaattgtttttcctgaaaaattagaaactaatttgacaaaaataaaaccaaaacagatattttttaaatttcaaaattatttcctctccaacagatagaaaaccacataaaaaatagtgagtttttgatttgtttttctttcatttttatcaccaaactagtttttggaatttttttagaaaaatgattttgaaaactcaaccaaacaaaggtagtaatgactattccttggtaactttccaatggaaaaatgggaatcatatttcttcattattcattctcaaaattttgattgctttctattagtaagctaaattctaattgtatttcctgtaatacttctttgttgtggattattacaattaaggtaaaagttgacaaactatttaccatctagtcaattaaataattttttttttttttttggagtctatgtataggaaaaactatagataaaatgtcatttttattcatatcccttccttcccccattgttgccagccaaaactttctttcaccctagtgcaaattactccccttctttttctgctacagctgcaatgcccttgcctttctccttccacatctgcaacccccatccatctattgcactactgtagccccttccctcttctccttctacgatcattgtaccctttacatcaacctgccggtgtagttgaatcaacccaattcatttaattcatgtatagtgggtgtttgggaagtgggtttttatataggtttttttagttgtaggatattattggataaaaaaattttggtgtttgggaagatagttgggtttttttgtgattggatgtgatgtttgtgagagaaaaagtgaaatgattatggggttggatgtgatattttgtttggatttgttttttttagttttgtaaaatctgtcttttagtaaaanagtgaaaaaaaaaaaaaaaaaacctaggcaaaattcttgccaaacaccgccataattgttatcactccagcatccaacctgcattccatagccacaaaacctcacaaataattccttgaaactgaagcatacaagagtacaccagattattgaggtaatttgaaaatgataaatgaggtgagcttttcctcgggggtgggggggtgattaaaaggagtgacgaaactgttggtaaattttttgaaaaatgaaatgtatgatggtatcaacaagaggtgtgagacatgcaaaaagggcgaagaaaggggtatgggcaaatgacattttatttatgtttttttcctcgactgtaaaacaagtttcatatatgactttggaatattattttttaatggatttgctggtaaaaaagtgtcaatttttgcttaattataaagatcccttatcatgagaaatttgccaaaagaattggaaataaaaattcaacaaagaaattcttgttttttcatggattgcttgtccaacaagtcaagcatttgcatttgaatagtaagcaaatcttgttctttcatggatggctttgtccaacgagtcaaacatctgcatatgaataggcatttgatgatctggttcaaaaaaaaaaaagaataggcatttgatgatatgtataattgtttatctaaactattggtgtggacacacacatcaacctgctattattgtctattatataaatatgcaatttcttctaggactctgacgtggaccattgctgtaatatttttttgcttcatag

SEQ ID NO: 205 - DNA, 106 bp, Camellia sinensis
  misc_feature: exon 5
aacaatattccagtcttctgccctggcttaactgacggctctttgggggatatgttatactttcattctttccgcaaccccggtctagtcgttgacgtagtgcaag

SEQ ID NO: 206 - DNA, 37 bp, Camellia sinensis
  misc_feature: intron 5
gtaaagcttctcctttgtatgtcgttttcatgcccag

SEQ ID NO: 207 - DNA, 284 bp, Camellia sinensis
  misc_feature: exon 6
tatacgataacttaggaaatgaattgatgaccttagctctatacatagatattagggccatgaatggtgaagctgtccatgcaagtcctaggaagactggaatgataattcttggaggtggacttcccaagcatcacatttgcaatgcgaatatgatgcgtaacggggcagattatgcagtctttattaacacagcgcaagagtttgatggtagtgattctggtgctcgtcctgatgaagctgtatcatggggaaaaatacgaggttctgctaagactgttaag

SEQ ID NO: 208 - DNA, 809 bp, Camellia sinensis
  misc_feature: intron 6
gtttaactttttttccttctcttttgtgaccttgaagcttctgttattagtataacctgtgcagatctgttggccaatttgcatcttttgttaattgtttgccattttggttatttgcatgcttgtttaatcaaatcatgaatcgaatcgtgaattgttttgctaaatagtgaatcggaaattgtaagattaattatttagcataaatgtagtatcacatctcttttataggccattttgtataattgacattacattctcttatccatttgtacacttggcaattaaagattattatgcaaaattgatttgaaatctctgtttttgcttactgcttcatacatctggtatatgttgaacaatccactggattactaaagtaatgcattgatttcaatatggtttctaatagttgtactgactttggaatggaaggcccatgttcaatccttactctatggaaccaaatttcctgaaattgccgaatggctaatctaagaaaatgcttcaagttacaaaacatatttgtggttaatttatcttgtttttgttgtgcaaaaacaacactgcttcattattatgcaaacaaaattgaattgcagtgacttgaagtgaatcacaaaatcatactgaatcgcaattgaatcataagttttgctcatcagtttaagatataacagcacaagttgaatagttttggttgaaatttgtcgaatcatatgaatcgaatcgtgaatcataaagattctaacaaccatggtcatagtatgattttaattgttttcggccttttgattggttctaaccag

SEQ ID NO: 209 - DNA, 90 bp, Camellia sinensis
  misc_feature: exon 7
gtacattgcgatgcgactattgcttttcctctactggttgcggaaacatttgctgcaaggggaaagagatcggccgagaacgagtcctaa

SEQ ID NO: 210 - DNA, 3145 bp, Gossypium hirsutum
ggttatcaaactagcttttgttgcacgcagcctcaacctcagcactctgctcccattcttcagctactctttttcttcatatcccatctccgccaccgttatcttctcatcttcaccgcaccgccaccgtctactggcgacaaccctgcaattaagtattcttgatacaataaagcaatctacgcattggtatgtttggtaacctatcagtgtagagttctttttcttttccgcttatggttgcagttctaagtatcaaagctaatcatatggagttttttttttctccagtggcagttttctttgcgaaggacgaaaggcggtaaaaggagataatggatgataagcttgtaaactctgtacgctctactgttttcaaagactcagattcccttgaagggacttgcactagaattgaaggttatgatttcaatcagggtgtaaactactccaggcttctcaaatccatgctttccactggatttcaagcttccaattttggagaagctgttgaaattgtcaatgagatggttggttttgtttatttagattttttccccttttagatggtttttgggaacttaaaattcaaaaagatagatttggattttaaaagtacttagcaatgtaatatttatgattatttctcaaaataatagatatattgggtgcatgtttagtagtgaatttgaaattcttttagatatttgtgaatttgaacttcatgccttttaaataaattatataatcgtattggatctctactagtttatacctaatgtatactattcatccttacaatttatatgttaaatgaaatccaaatccgaatctttctgatttatgttcccaaacgtagcattgttttcttaattcataaaggtattcttgatcaatgaagttagattggaggctttctgatgagcctatagctgaggacagcagtgaagaggagaaggatcctacctacagagaatctgtgagatccaaggtgtttttggggttcacatcaaatcttatttcatctggtgttcgagacactgttcgatatcttactgagcatcacatggtgagttccaaatcagactttcttttgtgtagaattggtatttttggaatacgcatttagtctttggcttcatttaaaaatctgtcatgttcttgatgccctagtgcctctggattttgagtactgttacttttgaaatgattttaggtagatgtaatagttactacaactggtggcatagaagaagatcttataaaatgtcttgctccaacatataagggtgatttttcgttacctggtgctcagttacgttcaagaggattgaatcgcattggtaacttgttggttcctaatgacaattactgcaaatttgaggattggatcattccaatttttgatcagatgttgaaggaacagcatgaagaggtacttttacacaaatacacacaccgattctgttatgtcatagatgttgctccactttatttttgaagtactggcattcagcatccatgtcaattacatatctagatatgagtatgagatatgaccctccaaggactttccaaataaatggaaaagtgttggataaaaaaaatttgaacatattcaagtcagactcacacatatctggtacatctgaatttgagttacataggtcatgccctctagtcagtctgatatttttgaattgtcacaatgattttgggaccttttagttttccataaatgttgaaaggatgattgatttcttgaatctaattattgtgtatggtagaatagctcagctttcatttgtagtcttttccagtgatttcagttaccatcagtacatgtttctcttgtgtctggtggtttctattatttctgttaatttcctcctacctcatgcttttggtctgtacagaatgtgttgtggactccatcaaagttaattgcacgtttgggacaagaaataaataatggagattcatacctctactgggcatacaaggcaagtatcattaccagtttagcctaatgctatgagcatgtaactactttttcgcctctgcttttttgttggtgtcaatgatgatctgtacagctgtccattcgttaactatgctcatttttgttatttatttgtattttccagaacaatattcctgttttctgtcctggattaacagatggctctttaggggatatgttgtattttcattcttttcgcaacccaggtctgataattgatgtagtgcaaggtaggtgctctatgttccatctacattgcttgttaactgctcctgttcaagaactggggacgtgaatatctaacttgattactttttgagcagatattagggccatgaatggtgaagcagtccatgcaagtcctaggaaaacaggaatgattattctaggagggggattgccgaagcatcatatctgtaatgctaatatgatgcgtaatggtgccgattatgctgtttacataaatactgctcaagagtatgatgggagcgattccggagcccgcccagatgaagctgtttcatgggggaaaatacgaggctctgctaaaacagttaaggtatgccttttgtctaccctattgcttttcatcttccattgttatacactctcttttcaacttttgcttaccctatatctttttcctcaaataaacaaatatatcatcttagttcctgactccttccatgatttgtatggaatcaggtacattgtgatgcaactattgctttccctcttctggtagctgaaacatttgcttcgaggtcgaaaaattttgtggcctagtaccatttttttcaaccgcacagattcatctaaatatcttattatttatctctgtggtggcatcctaatgaagacagatgatttctcatgatattatttatcaggtaacttgtacttttccatggtaaccaaaccatgctgagagttgtcgaaatttgttttaaagggagagtttattatagtgtagaagagtcagacgaatctgttatcactctttctagttcgttgtataagaattttggttgtagtgtagatgctattgatgaaattgctttcattttatggcaatatgtcaccattatcctctcctaatgcacccatctgatggttgaagaa

SEQ ID NO: 211 - DNA, 189 bp, Gossypium hirsutum
  misc_feature: exon 1
ggttatcaaactagcttttgttgcacgcagcctcaacctcagcactctgctcccattcttcagctactctttttcttcatatcccatctccgccaccgttatcttctcatcttcaccgcaccgccaccgtctactggcgacaaccctgcaattaagtattcttgatacaataaagcaatctacgcattg

SEQ ID NO: 212 - DNA, 102 bp, Gossypium hirsutum
  misc_feature: intron 1
gtatgtttggtaacctatcagtgtagagttctttttcttttccgcttatggttgcagttctaagtatcaaagctaatcatatggagttttttttttctccag

SEQ ID NO: 213 - DNA, 239 bp, Gossypium hirsutum
  misc_feature: exon 2
tggcagttttctttgcgaaggacgaaaggcggtaaaaggagataatggatgataagcttgtaaactctgtacgctctactgttttcaaagactcagattcccttgaagggacttgcactagaattgaaggttatgatttcaatcagggtgtaaactactccaggcttctcaaatccatgctttccactggatttcaagcttccaattttggagaagctgttgaaattgtcaatgagatg

SEQ ID NO: 214 - DNA, 371 bp, Gossypium hirsutum
  misc_feature: intron 2
gttggttttgtttatttagattttttccccttttagatggtttttgggaacttaaaattcaaaaagatagatttggattttaaaagtacttagcaatgtaatatttatgattatttctcaaaataatagatatattgggtgcatgtttagtagtgaatttgaaattcttttagatatttgtgaatttgaacttcatgccttttaaataaattatataatcgtattggatctctactagtttatacctaatgtatactattcatccttacaatttatatgttaaatgaaatccaaatccgaatctttctgatttatgttcccaaacgtagcattgttttcttaattcataaaggtattcttgatcaatgaag

SEQ ID NO: 215 - DNA, 168 bp, Gossypium hirsutum
  misc_feature: exon 3
ttagattggaggctttctgatgagcctatagctgaggacagcagtgaagaggagaaggatcctacctacagagaatctgtgagatccaaggtgtttttggggttcacatcaaatcttatttcatctggtgttcgagacactgttcgatatcttactgagcatcacatg

SEQ ID NO: 216 - DNA, 147 bp, Gossypium hirsutum
  misc_feature: intron 3
gtgagttccaaatcagactttcttttgtgtagaattggtatttttggaatacgcatttagtctttggcttcatttaaaaatctgtcatgttcttgatgccctagtgcctctggattttgagtactgttacttttgaaatgattttag

SEQ ID NO: 217 - DNA, 219 bp, Gossypium hirsutum
  misc_feature: exon 4
gtagatgtaatagttactacaactggtggcatagaagaagatcttataaaatgtcttgctccaacatataagggtgatttttcgttacctggtgctcagttacgttcaagaggattgaatcgcattggtaacttgttggttcctaatgacaattactgcaaatttgaggattggatcattccaatttttgatcagatgttgaaggaacagcatgaagag

SEQ ID NO: 218 - DNA, 481 bp, Gossypium hirsutum
  misc_feature: intron 4
gtacttttacacaaatacacacaccgattctgttatgtcatagatgttgctccactttatttttgaagtactggcattcagcatccatgtcaattacatatctagatatgagtatgagatatgaccctccaaggactttccaaataaatggaaaagtgttggataaaaaaaatttgaacatattcaagtcagactcacacatatctggtacatctgaatttgagttacataggtcatgccctctagtcagtctgatatttttgaattgtcacaatgattttgggaccttttagttttccataaatgttgaaaggatgattgatttcttgaatctaattattgtgtatggtagaatagctcagctttcatttgtagtcttttccagtgatttcagttaccatcagtacatgtttctcttgtgtctggtggtttctattatttctgttaatttcctcctacctcatgcttttggtctgtacag

SEQ ID NO: 219 - DNA, 87 bp, Gossypium hirsutum
  misc_feature: exon 5
aatgtgttgtggactccatcaaagttaattgcacgtttgggacaagaaataaataatggagattcatacctctactgggcatacaag

SEQ ID NO: 220 - DNA, 144 bp, Gossypium hirsutum
  misc_feature: intron 5
gcaagtatcattaccagtttagcctaatgctatgagcatgtaactactttttcgcctctgcttttttgttggtgtcaatgatgatctgtacagctgtccattcgttaactatgctcatttttgttatttatttgtattttccag

SEQ ID NO: 221 - DNA, 106 bp, Gossypium hirsutum
  misc_feature: exon 6
aacaatattcctgttttctgtcctggattaacagatggctctttaggggatatgttgtattttcattcttttcgcaacccaggtctgataattgatgtagtgcaag

SEQ ID NO: 222 - DNA, 93 bp, Gossypium hirsutum
  misc_feature: intron 6
gtaggtgctctatgttccatctacattgcttgttaactgctcctgttcaagaactggggacgtgaatatctaacttgattactttttgagcag

SEQ ID NO: 223 - DNA, 236 bp, Gossypium hirsutum
  misc_feature: exon 7
atattagggccatgaatggtgaagcagtccatgcaagtcctaggaaaacaggaatgattattctaggagggggattgccgaagcatcatatctgtaatgctaatatgatgcgtaatggtgccgattatgctgtttacataaatactgctcaagagtatgatgggagcgattccggagcccgcccagatgaagctgtttcatgggggaaaatacgaggctctgctaaaacagttaag

SEQ ID NO: 224 - DNA, 146 bp, Gossypium hirsutum
  misc_feature: intron 7
gtatgccttttgtctaccctattgcttttcatcttccattgttatacactctcttttcaacttttgcttaccctatatctttttcctcaaataaacaaatatatcatcttagttcctgactccttccatgatttgtatggaatcag

SEQ ID NO: 225 - DNA, 417 bp, Gossypium hirsutum
  misc_feature: exon 8
gtacattgtgatgcaactattgctttccctcttctggtagctgaaacatttgcttcgaggtcgaaaaattttgtggcctagtaccatttttttcaaccgcacagattcatctaaatatcttattatttatctctgtggtggcatcctaatgaagacagatgatttctcatgatattatttatcaggtaacttgtacttttccatggtaaccaaaccatgctgagagttgtcgaaatttgttttaaagggagagtttattatagtgtagaagagtcagacgaatctgttatcactctttctagttcgttgtataagaattttggttgtagtgtagatgctattgatgaaattgctttcattttatggcaatatgtcaccattatcctctcctaatgcacccatctgatggttgaagaa

SEQ ID NO: 226 - DNA, 3123 bp, Glycine max
atggctcaaacgttaaaacttaaaacaccgtctgtctctgttttgtggtgagaagaagagagagacagacagaacaatgggggaagcaaagggaaaggaagaagaagtgttagcctcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatggttggtttgttttctcttctctaacccccatctctttatattcacgtgattttttcgttataaaaattgaatatttggattgaagctagattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggtaagttagtttcccttcccttgttagatatatctatctgtcttaacttccttttggtaggagaacttcaaaaagggacacaattcatacaagtatttatgcacgcactaattgtaatttcagtctctttttttttagtgttagttactttcgctcctgtccctgtatatatatgctgggtgcctgttgttcttttttttttttttctctctctgagattgatttaatcagttttatgaataagagtttaacgtgtattgctctttctatcaaagggaagaaaaaaaaacaaattgactaattattacaattagcatacttggcaaatgttttcttatcctgtaaacaagtgcttcactggaataagtgaccatcctttgaactgcattaccatcaggagatgaaatatgagatatgtacacaaggccaatatctgctgcatttttttatgctttgagatgtaacatatttagcacagtcgataagaagacggacctggagtcccatctcagcccctggtatggtgaacctaatcgatacatagtagctgaattagcataaataagactaataggggtgaaaagataaactaaaagatgttctttccactcaaagcatataaatgttagaaacaagcatcagagaccagatacaatatgccaattagacaatgactcttgataccgatacttcttgagcctctctttttcacccttttcataagttattacttttatctagcaagaaaagtagcaaaataactttcttgtgagcaaatgtatattttcatatagaaaggtaaacaataataaggctgagatatctcatcttgacagattgcatcatatatatatatatatgaattgtgtccctttttgaagtctcattggtatatatgcttaatgatgttattgaattttgttgcatttattccacaatctgcaggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgaggtattttatttttgaacttctctgctcaatgcattagataatttacatggttttgtttttgtggaacgcctggagtcacattatttatgtgttgtattacttctaattcatgtcaattttgtgctaaccaaaatcaaactaaactataacttttagcacgattgaatgacaaaccttttatgtagcaggttctttttttagatttcacttgtaacctttttcctgacccttttttttttgcagaatgtgttgtggacaccatctaagttaatagctcgattgggaaaagaaataaaaaatgaaagctcttacctttactgggcatacaaggcaagaatgagaccaaccttagatttatagtaaattatgctattccctttaatctgtttctgatttgtatctttatcatagtttcttttctcattattctactgttgttgtgcatatttcttgtggcatttatatagtatatacaaaatgctatgtcgtcatttgtctcaatcttaagatttactgaacagtttggatttcagaatacagtttacaatataatattgataacatttcttaagatattttccagaacaacattccagttttctgtccgggcttaactgatggctcattgggggacatgctgtacttccattccttccgcaatcctggtctgattgtggacatagtgcaaggttttttctgctttctttctactttttactgcatgtataattttgaaaaatcaagaaccatagctaaataattagcgatacaacagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacatcctatgcaaactttcacaactggtttccttgtcatagttctttaacttttgccatgcatactgttgtttttgcttaaggatcatgagtttttttattacataattgtagccatgctgtaaggatgggcttagggagacccaaaatattcttataataccagcaattatatgaaagttacatttgatgggcttcttataaaaccagcaattaataaatatttgataactcaaccactctactcatacacatgaaatataaaatggtaccaaacacccagcaatacatataacccttaaatgtctttttgttacattaaatcaggtacactgtgatgcaacaatagcatttcctctgctggttgctgaaacgtttgcttcaagagtgaaacctccccattga

SEQ ID NO: 227 - DNA, 28 bp, Glycine max
  misc_feature: exon 1
atggctcaaacgttaaaacttaaaacac

SEQ ID NO: 228 - DNA, 260 bp, Glycine max
  misc_feature: exon 2
gtctgtctctgttttgtggtgagaagaagagagagacagacagaacaatgggggaagcaaagggaaaggaagaagaagtgttagcctcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatg

SEQ ID NO: 229 - DNA, 85 bp, Glycine max
  misc_feature: intron 2
gttggtttgttttctcttctctaacccccatctctttatattcacgtgattttttcgttataaaaattgaatatttggattgaag

SEQ ID NO: 230 - DNA, 168 bp, Glycines max
  misc_feature: exon 3
ctagattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatg

SEQ ID NO: 231 - DNA, 945 bp, Glycine max
  misc_feature: intron 3
gtaagttagtttcccttcccttgttagatatatctatctgtcttaacttccttttggtaggagaacttcaaaaagggacacaattcatacaagtatttatgcacgcactaattgtaatttcagtctctttttttttagtgttagttactttcgctcctgtccctgtatatatatgctgggtgcctgttgttcttttttttttttttctctctctgagattgatttaatcagttttatgaataagagtttaacgtgtattgctctttctatcaaagggaagaaaaaaaaacaaattgactaattattacaattagcatacttggcaaatgttttcttatcctgtaaacaagtgcttcactggaataagtgaccatcctttgaactgcattaccatcaggagatgaaatatgagatatgtacacaaggccaatatctgctgcatttttttatgctttgagatgtaacatatttagcacagtcgataagaagacggacctggagtcccatctcagcccctggtatggtgaacctaatcgatacatagtagctgaattagcataaataagactaataggggtgaaaagataaactaaaagatgttctttccactcaaagcatataaatgttagaaacaagcatcagagaccagatacaatatgccaattagacaatgactcttgataccgatacttcttgagcctctctttttcacccttttcataagttattacttttatctagcaagaaaagtagcaaaataactttcttgtgagcaaatgtatattttcatatagaaaggtaaacaataataaggctgagatatctcatcttgacagattgcatcatatatatatatatatgaattgtgtccctttttgaagtctcattggtatatatgcttaatgatgttattgaattttgttgcatttattccacaatctgcag

SEQ ID NO: 232 - DNA, 219 bp, Glycine max
  misc_feature: exon 4
gttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgag

SEQ ID NO: 233 - DNA, 243 bp, Glycine max
  misc_feature: intron 4
gtattttatttttgaacttctctgctcaatgcattagataatttacatggttttgtttttgtggaacgcctggagtcacattatttatgtgttgtattacttctaattcatgtcaattttgtgctaaccaaaatcaaactaaactataacttttagcacgattgaatgacaaaccttttatgtagcaggttctttttttagatttcacttgtaacctttttcctgacccttttttttttgcag

SEQ ID NO: 234 - DNA, 87 bp, Glycine max
  misc_feature: exon 5
aatgtgttgtggacaccatctaagttaatagctcgattgggaaaagaaataaaaaatgaaagctcttacctttactgggcatacaag

SEQ ID NO: 235 - DNA, 253 bp, Glycine max
  misc_feature: intron 5
gcaagaatgagaccaaccttagatttatagtaaattatgctattccctttaatctgtttctgatttgtatctttatcatagtttcttttctcattattctactgttgttgtgcatatttcttgtggcatttatatagtatatacaaaatgctatgtcgtcatttgtctcaatcttaagatttactgaacagtttggatttcagaatacagtttacaatataatattgataacatttcttaagatattttccag

SEQ ID NO: 236 - DNA, 106 bp, Glycine max
  misc_feature: exon 6
aacaacattccagttttctgtccgggcttaactgatggctcattgggggacatgctgtacttccattccttccgcaatcctggtctgattgtggacatagtgcaag

SEQ ID NO: 237 - DNA, 86 bp, Glycine max
  misc_feature: intron 6
gttttttctgctttctttctactttttactgcatgtataattttgaaaaatcaagaaccatagctaaataattagcgatacaacag

SEQ ID NO: 238 - DNA, 236 bp, Glycine max
  misc_feature: exon 7
atataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaag

SEQ ID NO: 239 - DNA, 328 bp, Glycine max
  misc_feature: intron 7
gtacatcctatgcaaactttcacaactggtttccttgtcatagttctttaacttttgccatgcatactgttgtttttgcttaaggatcatgagtttttttattacataattgtagccatgctgtaaggatgggcttagggagacccaaaatattcttataataccagcaattatatgaaagttacatttgatgggcttcttataaaaccagcaattaataaatatttgataactcaaccactctactcatacacatgaaatataaaatggtaccaaacacccagcaatacatataacccttaaatgtctttttgttacattaaatcag

SEQ ID NO: 240 - DNA, 78 bp, Glycine max
  misc_feature: exon 8
gtacactgtgatgcaacaatagcatttcctctgctggttgctgaaacgtttgcttcaagagtgaaacctccccattga

SEQ ID NO: 241 - DNA, 2768 bp, Glycine max
atggctcaaacgttaaaacttaaaacaccgtctgtctctgttttgtggtgagaagaagagagagacagacagaacaatgggggaagcaaagggaaaggaagaagaagtgttagcctcagttcactcaaccgtgttcaaagaatcagaaagccttgatggaaagtgtgttaagattgagggctatgatttcaaccgcggcgtcaattatccgttgctactcagctccatggtcacaactgggtttcaagcttccaacctcggtgatgccatccaagtcgttaatcaaatggttggtttgttttctcttctctaacccccatctctttatattcacgtgattttttcgttataaaaattgaatatttggattgaagctagattggaggctagttgatgaacccgtagctgaggattgcagtgaccaagagagggatttggagtaccgaaaatctgtgacgtgtaaagtgtttctgggtttcacttctaatcttatttcttctggtgttagagatactgtgaggtttcttcttcagcatcgcatggtaagttagtttcccttcccttgttagatatatctatctgtcttaacttccttttggtaggagaacttcaaaaagggacacaattcatacaagtatttatgcacgcactaattgtaatttcagtctctttttttttagtgttagttactttcgctcctgtccctgtatatatatgctgggtgcctgttgttcttttttttttttttctctctctgagattgatttaatcagttttatgaataagagtttaacgtgtattgctctttctatcaaagggaagaaaaaaaaacaaattgactaattattacaattagcatacttggcaaatgttttcttatcctgtaaacaagtgcttcactggaataagtgaccatcctttgaactgcattaccatcaggagatgaaatatgagatatgtacacaaggccaatatctgctgcatttttttatgctttgagatgtaacatatttagcacagtcgataagaagacggacctggagtcccatctcagcccctggtatggtgaacctaatcgatacatagtagctgaattagcataaataagactaataggggtgaaaagataaactaaaagatgttctttccactcaaagcatataaatgttagaaacaagcatcagagaccagatacaatatgccaattagacaatgactcttgataccgatacttcttgagcctctctttttcacccttttcataagttattacttttatctagcaagaaaagtagcaaaataactttcttgtgagcaaatgtatattttcatatagaaaggtaaacaataataaggctgagatatctcatcttgacagattgcatcatatatatatatatatgaattgtgtccctttttgaagtctcattggtatatatgcttaatgatgttattgaattttgttgcatttattccacaatctgcaggttgatgtagttgttacaactacaggtggcattgaagaagatcttataaagtgcctggcaccaacatataaaggagatttctctttgcctggagcatatctgcgctcaaaagggttgaatcggattggtaatttattggtcccgaatgacaactattgcaaatttgaggactggattattcctatctttgatcagatgttgggggaacaaaataatgaggtattttatttttgaacttctctgctcaatgcattagataatttacatggttttgtttttgtggaacgcctggagtcacattatttatgtgttgtattacttctaattcatgtcaattttgtgctaaccaaaatcaaactaaactataacttttagcacgattgaatgacaaaccttttatgtagcaggttctttttttagatttcacttgtaacctttttcctgacccttttttttttgcagaatgtgttgtggacaccatctaagttaatagctcgattgggaaaagaaataaaaaatgaaagctcttacctttactgggcatacaaggcaagaatgagaccaaccttagatttatagtaaattatgctattccctttaatctgtttctgatttgtatctttatcatagtttcttttctcattattctactgttgttgtgcatatttcttgtggcatttatatagtatatacaaaatgctatgtcgtcatttgtctcaatcttaagatttactgaacagtttggatttcagaatacagtttacaatataatattgataacatttcttaagatattttccagaacaacattccagttttctgtccgggcttaactgatggctcattgggggacatgctgtacttccattccttccgcaatcctggtctgattgtggacatagtgcaaggttttttctgctttctttctactttttactgcatgtataattttgaaaaatcaagaaccatagctaaataattagcgatacaacagatataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacatcctatgcaaactttcacaactggtttccttgtcatagttctttaa

SEQ ID NO: 242 - DNA, 28 bp, Glycine max
  misc_feature: exon 1
atggctcaaacgttaaaacttaaaacac

SEQ ID NO: 243 - DNA, 260 bp, Glycine max; identical to SEQ ID NO: 228
  misc_feature: exon 2

SEQ ID NO: 244 - DNA, 85 bp, Glycine max; identical to SEQ ID NO: 229
  misc_feature: intron 2

SEQ ID NO: 245 - DNA, 168 bp, Glycine max; identical to SEQ ID NO: 230
  misc_feature: exon 3

SEQ ID NO: 246 - DNA, 945 bp, Glycine max; identical to SEQ ID NO: 231
  misc_feature: intron 3

SEQ ID NO: 247 - DNA, 219 bp, Glycine max; identical to SEQ ID NO: 232
  misc_feature: exon 4

SEQ ID NO: 248 - DNA, 243 bp, Glycine max; identical to SEQ ID NO: 233
  misc_feature: intron 4

SEQ ID NO: 249 - DNA, 87 bp, Glycine max; identical to SEQ ID NO: 234
  misc_feature: exon 5

SEQ ID NO: 250 - DNA, 253 bp, Glycine max; identical to SEQ ID NO: 235
  misc_feature: intron 5

SEQ ID NO: 251 - DNA, 106 bp, Glycine max; identical to SEQ ID NO: 236
  misc_feature: exon 6

SEQ ID NO: 252 - DNA, 86 bp, Glycine max; identical to SEQ ID NO: 237
  misc_feature: intron 6

SEQ ID NO: 253 - DNA, 287 bp, Glycine max
  misc_feature: exon 7
atataagggcaatgaacggtgaagcagtacatgcaagtcccaggaagaccggaatgataattttaggaggtggccttccaaaacatcacatttgcaatgccaatatgatgcgcaatggtgcagactatgctgtttttatcaatactgcacaagaatatgatgggagtgattctggagctcgtccagatgaagctgtttcatggggaaagatacgagactctgctcagactgttaaggtacatcctatgcaaactttcacaactggtttccttgtcatagttctttaa

SEQ ID NO: 254 - DNA, 6171 bp, Homo sapiens
aaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatggtgaggaccgggcggaatttctagggacgcggaggggcgtggcttgtagaaccaacgcggtactagacgggggcagcgtttccagtggaggggatatgtcttttatttgagttgcccaatagttggaggaaggcgggacctattctgggcgggagtttctgtcctgggaaggggattttgcactctggtagttacatgctggtacggtaacctgaggaggcgaggactgattcttggtgtgggggcgggttctaggtacatttaaagctttctggaatgggcggagcctggggcaagacaaattaagggaggatatgggaggaggagcctaagtctgggcggttcttgaatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgccactgcactccagcctggtgacagagcgatactctgtctcaaaaaaaaaaaaaaaaaaaggccgggcacggtggctcatgcctgtaatctcagcattttgggaggccgaggcgggcggatcacctgaggtcgggagttcgagaccagcctgaccaacatggagaaaccccgtctctactaaaatgcaaaaaattagccgggcatggtggtgcgcgcctgtagtcccagctactcgggaggctgaggcaggagaatcgcttgaacccgggaggtggagcttgcagtgagccgagatcgcgccattgcactctagcctgggtaacaagagtgaaactccgtccaaaaaaaaaaaaaaaagggtgggggcaaatcctgaacgtgtgtcttgagatctggtctgggaaggggcagagtttacacaggagatgttccttggtcccctgtagaactggtcctgtatccctgaatgtgcagggcctggggtgaaatctgtttctggagcccacctggagtcctgagtctgggatttaaggccagtgcttaacttgacttggcccttactcacagatcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatggtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcaggtggacgtattggtgaccacagctggcggcgtggaggaagacctcatcaagtgcctggcgcccacatacttgggcgagtttagcctcagggggaaggagctccgggagaacgggatcaataggtgagaaccctgagtggtgttgggcaggggagctggaccaagggtcctggggcctgatgcctacatgcctcctgttctcaggatcggaaacctgctggtgcccaatgagaattactgcaagtttgaggactggctgatgcccattctggaccagatggtgatggagcagaacacagaggtggggctggggcaacctggaggggccagttcagtgggagtcaggggaggcatggcctgaaggtcacatcctctcctagggtgtaaagtggacgccttctaagatgatcgcccggctgggcaaggagatcaacaacccagagtccgtgtattactgggcccagaaggtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctcagcatccttatgctcctcccagactatctctggaacagtagaggcaacacttagcaactctcctggggcctggctcagggtcccacactcccagatgctataaaataagagctacccactccctttaattagagaatcagaacctgaaaaaaaaaaaaaaaaagctacatagtctttttttttttttttttttttttgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctggagtgcaatggcacaataatggctcactgctgtcttgagcttctgggctcagtcgattctcctgcctcagcctgctgagtagctgggactacaggtgcgtgccaccatgcctggctaattgtttttgtagagatgggaactcaccatgttgcacaagctggctctttttttttttttgagacggagttttgctcttgttacccaggccagagtccaatggcgcaatcttggctcacagcaacctctacctcctgggttcaagcaattctcctgcctcagcatcaagttcccaagtagctgggattataggcatgtgccaccacccctggctaattttgtatttttagtagaggcagggtttctccatgttggtcaggctggtgtcgagctcctgacctcaggtgatccacccgcctcggcctcccaaagtgctgggattacaagcgtgagccaccgcgcccggccacaagctggctctttaaaaaagaattagacggccgggcacggtggctcatgcttgtaatcccagtactttgggggctgaggcgggtggatcacctgaagtcaggagttcaagaccagcctggccaacatggtggaaccctgtctctactaaaaaaacaaaatgcaaaattagctgggcatagtggcatgcgcctgtaatcctagctactcgggaggctgaagcaggagaatcactggaacccaggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcagaaccacatccctgtgtttagtcccgcacttacagacggctcgctgggcgacatgatcttcttccattcctacaagaacccgggcctggtcctggacatcgttgagggtgaggcgctagggccacagaggagaggggaaggagggctggctgagtccaaggcctgacttcggcgctcttcccccagacctgaggctcatcaacacacaggccatctttgccaagtgcactgggatgatcattctgggcgggggcgtggtcaagcaccacattgccaatgccaacctcatggtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacagcggaacggggccgactacgctgtttacatcaacacagcccaggagtttgatggctctgactcaggtgcccgaccagacgaggctgtctcctggggcaagatccgggtggatgcacagcccgtcaaggtaagcgctggctgggtggggcatagggtctctgggacgatgagtgtgggtcccatggcttacccaggttcccccctacccaggtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttcca

SEQ ID NO: 255 - DNA, 328 bp, Homo sapiens
  misc_feature: exon 1
aaagcacgttccctacttcctgtgctcttgcggagacgcgcgcgtcggggtttaacgcgtttctgggccgccgtaagcccggcctaggggcagctttgactcgagagccggctataggcgcatggaaggttccctggaacgggaggcgccagcgggggcgctggccgccgtgctaaagcacagctcgacgttgccgcccgaaagcacccaggtccggggctacgacttcaaccgcggtgtgaattaccgcgcactgctggaggccttcggcaccaccggcttccaagcaaccaacttcgggcgcgctgtacagcaagtcaatgccatg

SEQ ID NO: 256 - DNA, 1234 bp, Homo sapiens
  misc_feature: intron 1
gtgaggaccgggcggaatttctagggacgcggaggggcgtggcttgtagaaccaacgcggtactagacgggggcagcgtttccagtggaggggatatgtcttttatttgagttgcccaatagttggaggaaggcgggacctattctgggcgggagtttctgtcctgggaaggggattttgcactctggtagttacatgctggtacggtaacctgaggaggcgaggactgattcttggtgtgggggcgggttctaggtacatttaaagctttctggaatgggcggagcctggggcaagacaaattaagggaggatatgggaggaggagcctaagtctgggcggttcttgaatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatggtgaaaccctgtctctactaaaatgcaaaaaattagccgggcatggtgttgcgcgcctgtagtcccagctactcgggaggctgaggcaggagaatcgcttgaacccgcgaggtggaggttgcagtgagctgagattgcgccactgcactccagcctggtgacagagcgatactctgtctcaaaaaaaaaaaaaaaaaaaggccgggcacggtggctcatgcctgtaatctcagcattttgggaggccgaggcgggcggatcacctgaggtcgggagttcgagaccagcctgaccaacatggagaaaccccgtctctactaaaatgcaaaaaattagccgggcatggtggtgcgcgcctgtagtcccagctactcgggaggctgaggcaggagaatcgcttgaacccgggaggtggagcttgcagtgagccgagatcgcgccattgcactctagcctgggtaacaagagtgaaactccgtccaaaaaaaaaaaaaaaagggtgggggcaaatcctgaacgtgtgtcttgagatctggtctgggaaggggcagagtttacacaggagatgttccttggtcccctgtagaactggtcctgtatccctgaatgtgcagggcctggggtgaaatctgtttctggagcccacctggagtcctgagtctgggatttaaggccagtgcttaacttgacttggcccttactcacag

SEQ ID NO: 257 - DNA, 165 bp, Homo sapiens
  misc_feature: exon 2
atcgagaagaagctggaaccactgtcacaggatgaagaccagcacgcggacctgacccagagccgccgcccacttaccagctgcaccattttcctgggatatacatccaacctcatcagttcaggcatccgtgagaccattcgctaccttgtgcagcacaacatg

SEQ ID NO: 258 - DNA, 238 bp, Homo sapiens
  misc_feature: intron 2
gtggggacctggtgaggccgtggccttggcctctgggtcaatgggcaatgcagttattgatcgtttaagtgagatgggcagataggggtctgttataagcagaggaatagaatcaagttttgttttgtagcagagctccctcataagagtcactggacaaggatgaggttagaagttctgcccagaatgagggcaggggcttccttcttgggccaaattcactgccttgtggctgcag

SEQ ID NO: 259 - DNA, 122 bp, Homo sapiens
  misc_feature: exon 3
gtggacgtattggtgaccacagctggcggcgtggaggaagacctcatcaagtgcctggcgcccacatacttgggcgagtttagcctcagggggaaggagctccgggagaacgggatcaatag

SEQ ID NO: 260 - DNA, 81 bp, Homo sapiens
  misc_feature: intron 3
gtgagaaccctgagtggtgttgggcaggggagctggaccaagggtcctggggcctgatgcctacatgcctcctgttctcag

SEQ ID NO: 261 - DNA, 97 bp, Homo sapiens
  misc_feature: exon 4
gatcggaaacctgctggtgcccaatgagaattactgcaagtttgaggactggctgatgcccattctggaccagatggtgatggagcagaacacagag

SEQ ID NO: 262 - DNA, 79 bp, Homo sapiens
  misc_feature: intron 4
gtggggctggggcaacctggaggggccagttcagtgggagtcaggggaggcatggcctgaaggtcacatcctctcctag

SEQ ID NO: 263 - DNA, 87 bp, Homo sapiens
  misc_feature: exon 5
ggtgtaaagtggacgccttctaagatgatcgcccggctgggcaaggagatcaacaacccagagtccgtgtattactgggcccagaag

SEQ ID NO: 264 - DNA, 2060 bp, Homo sapiens
  misc_feature: intron 5
gtgaggacctaagcgggagcaaagtagccagactttggcatgtgttaacttatttcatctttccagcctcctggggattcagtactgttattctcagcatcctcactcttagatgaggagactcaaacacagataggcgtggtaattttttttttttttgagacaggatcttgctctgtcacctaggctggagtgcagtggtgtgatcacagctcattgcagcctcaacctcctggggccaagcagtcctcccacctcagcctctcgagtagctgggaccacaggcacatgccatcatgcccagctaattttaaaaattttttgtagagatgggggtctccctgtgtttcccaggctggtcttgaactcctggcgtcaggcagtcctcccaccttggcctcccaaagtgctgggattacaggcgtgagccactgtgcccagccaggctaggtaattttgtctgaagtcacacagataactagtggggcctcagcatccttatgctcctcccagactatctctggaacagtagaggcaacacttagcaactctcctggggcctggctcagggtcccacactcccagatgctataaaataagagctacccactccctttaattagagaatcagaacctgaaaaaaaaaaaaaaaaagctacatagtctttttttttttttttttttttttgagacagagtcttgctctgtcgcccaggctggagtgtaatggtgtgatttcagctcactgcaccctccacctcccaggttcaagtgattctcccgcctcaccctcctgagtagctgggactataggcacccaccatcatgcccggccaatttttgtatttttctacagatggggtttcaccatgttggccaggctggtcttgaactcctgacctcaagtgatccacccgccttggcctcccaaagtgctgggattacaggggtgagccaccacacccagcctacttactctttcttttttacgagacagggtctcattctgtttcccaggctggagtgcaatggcacaataatggctcactgctgtcttgagcttctgggctcagtcgattctcctgcctcagcctgctgagtagctgggactacaggtgcgtgccaccatgcctggctaattgtttttgtagagatgggaactcaccatgttgcacaagctggctctttttttttttttgagacggagttttgctcttgttacccaggccagagtccaatggcgcaatcttggctcacagcaacctctacctcctgggttcaagcaattctcctgcctcagcatcaagttcccaagtagctgggattataggcatgtgccaccacccctggctaattttgtatttttagtagaggcagggtttctccatgttggtcaggctggtgtcgagctcctgacctcaggtgatccacccgcctcggcctcccaaagtgctgggattacaagcgtgagccaccgcgcccggccacaagctggctctttaaaaaagaattagacggccgggcacggtggctcatgcttgtaatcccagtactttgggggctgaggcgggtggatcacctgaagtcaggagttcaagaccagcctggccaacatggtggaaccctgtctctactaaaaaaacaaaatgcaaaattagctgggcatagtggcatgcgcctgtaatcctagctactcgggaggctgaagcaggagaatcactggaacccaggaggcagaggttgcagtgagctgagatagtgccattgcactccagcctgggcaacgagtgaaactccgtctcagggaataaaaaaaaagagagagaaacagctcagcaagctaagaataggctggttctttatgtgccaggcactatactaagtgttttctgtgggttttctcatataggcctcatctgtgagaggtgtttctgttatgcttataattgaggaaacagtcctagagaaattaggcaccccatccacagtcagatagtcatatagccagcatggagacgaggctctgagctccagccactgtcctgtcatgttctctgcag

SEQ ID NO: 265 - DNA, 106 bp, Homo sapiens
  misc_feature: exon 6
aaccacatccctgtgtttagtcccgcacttacagacggctcgctgggcgacatgatcttcttccattcctacaagaacccgggcctggtcctggacatcgttgagg

SEQ ID NO: 266 - DNA, 79 bp, Homo sapiens
  misc_feature: intron 6
gtgaggcgctagggccacagaggagaggggaaggagggctggctgagtccaaggcctgacttcggcgctcttcccccag

SEQ ID NO: 267 - DNA, 104 bp, Homo sapiens
  misc_feature: exon 7
acctgaggctcatcaacacacaggccatctttgccaagtgcactgggatgatcattctgggcgggggcgtggtcaagcaccacattgccaatgccaacctcatg

SEQ ID NO: 268 - DNA, 965 bp, Homo sapiens
  misc_feature: intron 7
gtgagtgggggtggcgcttcggcccactctgcagacatgctgtgtggtgggcctatgccatgtgctgggtagacagcatgaactagacaggccaggatccctgctccccgggactgatgttctagtaggggagatagcaaacaagtgacatccacgtcagggggcagtcattgctacggggaatactaaatgatggcatgagaagagaaaggggtgctgtccaacaagaggttttggaaggaggcttctggaagtgtgagctgggagcaggggtttggggaggcatctcccaggagctatgtggttgtctcccgtgccaggagtttgtgctgctgtactagcattgagcttctggattgcaaagttcccaggagagggaacagccattgcaaaggctctggggcgcctgaagtaatccaggaacagctgggtacctggtgaggggaaggtggagtggtgagggccaggaggtgatgcagggaggtgccacagggagcctgctgggccctgtgggctgaggcggggctttggcttttgcactgagagaagtgggagaggacttgactcgggttcccatgctccccctggtggccatgtggtgaacagatggtggcaggtgagtgagaactccagtccaggacagtggtgaccatgcagggatcaggaggcaggcggtggttggatttggagggcttctgaagatagagttgctggcagctcctgccttgcagatggggcagggttgttgacacctggctgttgggtctggggaaacacagccatcgttgcccagcagctctagtgaccccagacattgacatgggccctgtctgggagcgaatgtctgtgaagggcttccttcatctgggacacacctctcagcctgtttggctacggtgtcctccctctgtgtctgtctcctgtgactggctgactgggcccaccgtgcccccgcctccccacag

SEQ ID NO: 269 - DNA, 126 bp, Homo sapiens
  misc_feature: exon 8
cggaacggggccgactacgctgtttacatcaacacagcccaggagtttgatggctctgactcaggtgcccgaccagacgaggctgtctcctggggcaagatccgggtggatgcacagcccgtcaag

SEQ ID NO: 270 - DNA, 83 bp, Homo sapiens
  misc_feature: intron 8
gtaagcgctggctgggtggggcatagggtctctgggacgatgagtgtgggtcccatggcttacccaggttcccccctacccag

SEQ ID NO: 271 - DNA, 217 bp, Homo sapiens
  misc_feature: exon 9
gtctatgctgacgcctccctggtcttccccctgcttgtggctgaaacctttgcccagaagatggatgccttcatgcatgagaagaacgaggactgagcggctgcggtcccaggaaggtcttaccccctcttctatttattaatttgcagacccagcccctcccctactttttggtcagctacgtctctagaataagatggtatctgaagtccttcca

SEQ ID NO: 272 - DNA, 1760 bp, Lactuca sativa
atgggggaagtcgttaaagaggcaggggtgattgagaacttaaggtcggtggtgttcaaggaatcagagagtttagaaggcagctgtgctaaaatccagggctacgatttcaacactgggattaattattcgcagattctcaaatccctaatttccactggattccaagcttctaacctcggtgatgccattgaaaccgttaatcaaatggtaagtggttcgttctcagattctttaccacgtatattgtttttatcttttggaattaggtttttcatgtttgtatgatcttgaggcgtccaatttgttgattgtagctagactggaggctttctcatgagcaagtaaccgaagattgcagtgaggaagagagtaatccagcttacagagagtctgtcaagtgcaaaatctttctagggttcacttcaaacctcatttcttctggtgttcgagacattattcgctatctaactcaacatcatatggttagtaatttgcaacttttatgatgataaacatacgaatcagttttattctttttataactaaaaacttttgtgttataatatataaaatccaggttgatgtgattgtgacgacaaccggtggcattgaggaagatctgataaaatgtcttgcagacacatacagaggtgaattttctctacctggtgctgccttaaggtcaaaaggtcttaatcgtattggtaacttattggtgccaaatgataactactgtaaatttgaggattggattatcccaatattcgaccaaatgcttcaagaacaaaatacacaggtattcattgtattttcattcaaggtgttgttgatttacatttttgtaatctgttctttagattcaaaatcctttccatcatataataaatttatactctatccgctttgtgtttaacagcatgtgttatggactccatcaaaagtaatatcacgtttggggaaggagattaataatgagagttcttatttatattgggcatataaggtaatcccatgctcacattatttatttatttttttaaaaaaatctctccattctgatggtttggagttgggttactattatatttatgcaataacatgattagttttattgtagaacgacattcctgtgttttgcccaggcttaacagacgggtctctaggggacatgttatatttccattcatttcgcaatccgggtcttgttattgatgtagtacaaggtgacatgacaattttctctcatcttgactttcttcaattattattattattattattattattacaatcattttgcatgtgttataatttgtgaaaactgatcaacagatatacgcgcgattaacagcgaggctgtgcatgcaaaccctagaaagacagggatgataattctaggaggagggttaccaaaacatcacatttgtaatgcgaatatgatgagaaatggtgcggattatgctgttttcatcaacactgctcaggagtttgatggcagtgattctggtgctcgacctgatgaagctgtctcctgggggaaaatacgtggttctgctaaatctgtcaaggtttttcattaaaataaatacaatgttttattttttttggtgaagttttttatttaaatggttttgattgttttgatccaggtgcactgtgatgcaactatcgcgttccctttacttgttgcagaaacatttgctgcaaagagagagggggagatgaaaaatgttgagtcaaccaaagctttggtttaa

SEQ ID NO: 273 - DNA, 210 bp, Lactuca sativa
  misc_feature: exon 1
atgggggaagtcgttaaagaggcaggggtgattgagaacttaaggtcggtggtgttcaaggaatcagagagtttagaaggcagctgtgctaaaatccagggctacgatttcaacactgggattaattattcgcagattctcaaatccctaatttccactggattccaagcttctaacctcggtgatgccattgaaaccgttaatcaaatg

SEQ ID NO: 274 - DNA, 107 bp, Lactuca sativa
  misc_feature: intron 1
gtaagtggttcgttctcagattctttaccacgtatattgtttttatcttttggaattaggtttttcatgtttgtatgatcttgaggcgtccaatttgttgattgtag

SEQ ID NO: 275 - DNA, 168 bp, Lactuca sativa
  misc_feature: exon 2
ctagactggaggctttctcatgagcaagtaaccgaagattgcagtgaggaagagagtaatccagcttacagagagtctgtcaagtgcaaaatctttctagggttcacttcaaacctcatttcttctggtgttcgagacattattcgctatctaactcaacatcatatg

SEQ ID NO: 276 - DNA, 95 bp, Lactuca sativa
  misc_feature: intron 2
gttagtaatttgcaacttttatgatgataaacatacgaatcagttttattctttttataactaaaaacttttgtgttataatatataaaatccag

SEQ ID NO: 277 - DNA, 219 bp, Lactuca sativa
  misc_feature: exon 3
gttgatgtgattgtgacgacaaccggtggcattgaggaagatctgataaaatgtcttgcagacacatacagaggtgaattttctctacctggtgctgccttaaggtcaaaaggtcttaatcgtattggtaacttattggtgccaaatgataactactgtaaatttgaggattggattatcccaatattcgaccaaatgcttcaagaacaaaatacacag

SEQ ID NO: 278 - DNA, 120 bp, Lactuca sativa
  misc_feature: intron 3
gtattcattgtattttcattcaaggtgttgttgatttacatttttgtaatctgttctttagattcaaaatcctttccatcatataataaatttatactctatccgctttgtgtttaacag

SEQ ID NO: 279 - DNA, 87 bp, Lactuca sativa
  misc_feature: exon 4
catgtgttatggactccatcaaaagtaatatcacgtttggggaaggagattaataatgagagttcttatttatattgggcatataag

SEQ ID NO: 280 - DNA, 114 bp, Lactuca sativa
  misc_feature: intron 4
gtaatcccatgctcacattatttatttatttttttaaaaaaatctctccattctgatggtttggagttgggttactattatatttatgcaataacatgattagttttattgtag

SEQ ID NO: 281 - DNA, 106 bp, Lactuca sativa
  misc_feature: exon 5
aacgacattcctgtgttttgcccaggcttaacagacgggtctctaggggacatgttatatttccattcatttcgcaatccgggtcttgttattgatgtagtacaag

SEQ ID NO: 282 - DNA, 109 bp, Lactuca sativa
  misc_feature: intron 5
gtgacatgacaattttctctcatcttgactttcttcaattattattattattattattattattacaatcattttgcatgtgttataatttgtgaaaactgatcaacag

SEQ ID NO: 283 - DNA, 236 bp, Lactuca sativa
  misc_feature: exon 6
atatacgcgcgattaacagcgaggctgtgcatgcaaaccctagaaagacagggatgataattctaggaggagggttaccaaaacatcacatttgtaatgcgaatatgatgagaaatggtgcggattatgctgttttcatcaacactgctcaggagtttgatggcagtgattctggtgctcgacctgatgaagctgtctcctgggggaaaatacgtggttctgctaaatctgtcaag

SEQ ID NO: 284 - DNA, 81 bp, Lactuca sativa
  misc_feature: intron 6
gtttttcattaaaataaatacaatgttttattttttttggtgaagttttttatttaaatggttttgattgttttgatccag

SEQ ID NO: 285 - DNA, 108 bp, Lactuca sativa
  misc_feature: exon 7
gtgcactgtgatgcaactatcgcgttccctttacttgttgcagaaacatttgctgcaaagagagagggggagatgaaaaatgttgagtcaaccaaagctttggtttaa

SEQ ID NO: 286 - DNA, 8036 bp, Musa acuminate
  misc_feature (6545)..(6799): n is a, c, g, or t
gcgatcgcccttctcttctgcgccggcgcggcgcccgcaacgaatcttgcagagagtaagaaggatcctcgcctttgtcaccaaacccttggtttccagggaggcgacatggaaggcggcgccgcgggagggcagcgagaccgggaaaccctggacgcggtgcggtcggtggtgtttaagccctccgtatccttggaggagaagcggttcccgagggtccaggggtacgacttcaaccggggttgtgacctcatcggcctcctcgattccatgtccactaccgggttccaagcttccaacctcggcgacgccatcgatgtcatcaatcagatggtgagcccacgcccgtaggcccccctctggattcctgtagtttctgctgacgatcgccgcaagtatcggttcttggagataattttgttctttcttcccgttcgcttatcgtttgggacggaatgaagattgactggaggctctcccatgatgcgcccacggaagattgcagcgaggaagagcgcaatctggcctacaggcaatcggtcacgtgcaagatctttctgggcttcacttcgaaccttgtatcttctggcatcagggagataattcggtttcttgtgcagcaccgaatggtgagtgcatgtcattggcactattcttctttattcttgaaggtttaggttcaggttcttgggaagttcaacgcacaatacatcaagaacaccaaagaatatagaaccattccattcaatatttagttaccatttgatagggcatatttcagcaccacctacgtggcagcgaccagcagccacctcaagccgacatggtgcatccgtgccattgtggcacctcgagcttgtgcacgacgagaacccacacccgggggatcgatggccattaacgaactccatacgatcgaccctcgacaataggtataaaaatggatcccttggtcaatgccaaggggaaacgaaaacacactcgaattgaccgcaactccaccatactaacttaagcttatgagggggcacgaaaacacactcgaattgaccccaactccaccatactaacttaagcttcagagaggtcgagtcaggattttccttcccgaccctagcctgtctgctgcaacccagcaaggaaagaaaaacaactcccagtgcaacctcagatcagctcgacgaacagcgccctggcccctcctgacgccagccctctccagcccgagagccacgtggatgaccttgcacgtttggatcggaccgagccatgctgacgactcagtcatgacataaagttgtacaaacaccattaaagcaagactgaatctgtgattgtttttcttagtatgtcaagaaccctcgtgaatcctatattgatgccaacaaattcgacatgtttggcaggatctttaagatttatgcatttttcatggattcaagactgttctttctctaaatccaaaatattgaactttgaaccatctgaagtcagtttacatctaaacaaatggaccatatttttcttgttatttgcattctacctttatgcagtccactcttatttgttgattcttttctaatcttttctcaaaagaaatggaataagggactaaatttacaagacaacatgaaactgactttatcatatctcagttaaatttctgaagcactagatagtttgtatttctttactctaatgttttgctgcttctttagtaaaggttgtaatatatggtaggggctttctttatgcccatttatcaatgttcatttgctttaatagctttgtggcacgtctaggttgaagttttagtcacaactgctggcggcattgaagaagatttaatcaaatgccttgctcctacatataagggtgacttttctttgcctggatcgtatctgcgttcaaaaggattgaatcggataggaaaccttctggtccctaatgacaattactgcaaattcgaggactggatcatgccaattctggaccagatgttacttgaacagactacagaggtaggactgatcatctttaagtttttgctactctatgctcctcaattgtcttttaattagcagacgaaaccttggcatgtcagttcctggcaagtgattcatattcttattgtactgatcattctctagcgctttcatgcaagtttttgtaggcatgattacttgttggccgtccaacttctgtagttattaatttcattgtcatatcatgcaggtcctgataaaattgacacaaggtttgacaacggtcatgtttttccaacaattgccaccatatgagacattaatgaatgctttattttatgatagagtattcttttttgttaaccttcttcgtgtgtgtgcatatctgtgctttgtgctttcccagactcacaaatggggccctagtgcatcaggctatctttggcaattataacagctctgagctacctcttgtacatgaatgcatagtagtttcatcatcttatctaattcacaataaccttgatatggctatgacataaagtagctgttgttgtgacttgtgagactgtagttagaaactgttatatgccatttcaataagtaatgctgttttactaggaggcaattgtttttttattatttttatctttgcctgtttaaataagttatattcttttatggcttaaaatttgcttagtgtattaaattgcatggagggaatgatgatgatctagtaaggccaagcttagatattaaaagatattttggtattttgaggattctgtttgaagaatgatggccagcttttctttaggcggggtttcacctgcttgggatgctgctgcttggatatgttgctcggcatatatttgtgtggcacttaattaaaatactggtaattgcagactaattaatggaactaaaacttatgtttgattttctgcttataattttatgtagtttcctttattatgaacaattccccttttagggttggatctttttatttatcaactgctattgattatattatcacagttaatgatctgcaaaacctgtacatatcctagactattttgtgaaaaatttaacatatttgtaaatttacatttgttttcttctaccagttttagtgtcatttagaacacaatactagattgcaattttgtagctctttcacatgcttgtttattcaggtattatcacaaatagaagtttgtagcacatattgttttctcacagaatgtgatatttgcttgtgctcacagaatgtagtttggactccatcaaaagtgattgcgcgccttggaaaagaaataaatgatgaaagttcatacctgtactgggcatacaaggtactagcagttattttcatctttttgctgccttgattgttttaaattactacaggttcaaacttattaacatgtggctattgtgtctaaagattgcttacctctatagctgtggcccttagtttttaatgacgtatatatttgtatgtataatatgtattttttagatgtcactacattgagaaacagatggtgattaatgaaattaagatgatgattgatcttctttcatcttaagctcgtgttttcttttctacatgctcagatctttatggtttcttccttgaagaattaagtcagggatgaaagtcaattcattgttattgattataatggtttcataatatatgtcaaactttgttgtatacattattatatactagatattttcattgttgtcgtatcttgtgccttatcatatccttttgtaacatgttgtttaattatccatgttgtgtcagcactccatgtcataccaatgattacaagtgttctttcgggtaattcagtataactttaattgcaacagtcagagcacttgacaactctgtaccatcaaacagtgttttgcttctttttcatgtagctctaggctttgcaattataaaagatgaatctataggaaagcagccagatgttttttctcgctaatttgagatagtccagcctgtgtatagaaaataatgatacttccttatttattctatccaatggtttatatttcatggttttgtatcagtatgttactctctatttattactaaaccttgttgcaatttgatcagaacaatgtttctgtctattgcccggcattgactgatggatcattgggggatatgttgtactgccattcagtgcggaatcctggtttacttattgatattgtgcaaggtacagccttttttgttactcaattgcttttgcctatttgcatcctgcttatgttgacatttcatcatccagacatacgagcaatgaatggagaagctatacatgtgggtctgagaaagactggggtcataattcttggtggggggctcccaaagcaccatatatgtaatgccaacatgtttcggaatggtgcagattatgctgtttatgtcaacactgcacaggaatttgatggaagtgattctggagcacagcctgatgaggcgatttcatggggaaagataaagggttctgcgaagactattaaagtatgtgtgctgatctttcttgtccaatcatttttctcctcttcttttccctttcaatatcatatacctattaataattacatgccctttctaggtcagacatgataagcctctttcactaatagtagtaagattagaaatataggttttcctaaaaatatgttgctttttaattgataaattacataatattttaggacatcatgaattttgtgtgatgagggtgggcctcggtagttagtagttgcttctttgtgacttgggagatcagggttcgagttacgaaaataatctctttaaatatataaatataagattgcatacattgacttgggagatcagggttcgagttacgagaatcttgtgcgttgggtacaccctttttagaagttttttgtaatcattaataccttttaattaagaggaaagttctacaagatcgttattagactagtgatattttatggatttgagcattggacaattaagaaatattgaggatgtgaactaatatgccatactatatgcttcactttttagagcagtttactctatgtcagaaagaattgatttgtatggggtttggggtcgatgatccatcgacttcataccatctttcgcatgaaagttttggtggaggagaaaactattgctggaaggccaagtgtaaaaacctaaaggaaaacaacatttattgtttgtaaagttaaaagtgttaattacaagacttgaaacaatggaataaaagtgtgatagaagactttggtctcttcctttctcattgctggaacatcctcctgaggtttgaatagtagacaacaggctttgggggcttctcaaagcagctggatggagcttgatgcagagcttcaactattggaacttgaggaagaaggttgcggttggaaggattggttgcacttcgtagaattcttcccttctcttctcctctcttctcttttgaggctggaacaactagggccggttggacacatgctggaggattcttggtttcccttgggctcccttaggtaggtctctcctccttttatagctgaggaaggggtgtagtcctagctaggttagaacttagagagtcctaatgccttaggtcttggagagtcctaatgccctttaggacttgttttagggctggcacatgagagtcctactcctattaggagttggcaccaccctctccttgtgactacccctatttgggcgagggctatcctaatcctagtcttagtaggactcgaattgaggcaagtgggctgctatgatatgatttcatggcttcaagaggcccttcaatagaggttggccaattttgtcttgtgctgttgagatcgtccctaatcaagaataagctctttgctctctttttctttgatttcatggcttcaagaggcccttcaatagttatctagatcttccacagttgcacgcatcatcaccaatttccttatagtgaaatgagaaattgtagaaggatgactcccaatccttcttgtactatggatttacggaaccatccttcgattaactaggaaacaaccatctttgaccaacatttttcttttccacaggatgcaacttcgttatctagattgttgggatgcagtattgatgtgtaattataaatttgggcttatgtatagagactctatatgaaagttagactaaatttaatgacaaacatatgaagtgcaatttaaataacaaaaatagaatatttgaagatataataaaaatagatggataaagcatttgtactagcaagtctttggagctgttattcgataggaaatgaagattgaaaagacacataaaacaagatgattggttaaatcagagaggagaatttagtctattatgtggtaatcatgtgattcttggatggaaagggcaactttaaggcattgctagtcttcgtctaccatatgaatttgataggattcacacacacacacacacacacatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatatatatatatatatggagttgctagaagagataagacaacaatatgtgcacctgtgaacaattaaagtagttctaattgatgataaagtagggaaaccgattaaggtggtttgaacacatgtggatgtatcagttagtcaaggacagaactcagattagtgctgctatgtgccatagaagacttcttggaacagtaggattgaatttgaggtcactttggcttttgtgttattgctacatcaatgatggaaaaagattgatgtttcaattctgatcagttgtgagtgtcattatactcgatgcaagattagttgacatgatttttgtggaaatttcaaattcttgattagtaaaatgaagaaggtagaattagatattctatcacaacatgacgcatagagaatattgtctaggactgattagctgtaagtgccaacagacctaaagcaagaggaaccacagttgtgctccactcttaaatgtggcagctgctcggaggacaagggaaacgattttttcaactgttgttgtgaataagatattaagttgaacactccactgtgcaccaatagggtatttgagattatgtttccatctacatgtatatattgcttcatgatctgaatgaagttattttctgtcttgtcaaaacaagttaggtgatatgaatggttagattctgaacattacctgtgttaagtttcacttttgtaattctaatgttgactaaaccaagcaggttcattgtgatgcaactattgcttttcctctattggtagctgcaacatttgcaagaaagtttcaggaaagaaacaacaaattagcctgatgggggtgcaaaaggtgatcatcttatttggattcaaataccctaatgtaatctgctaacatctgcagatgctgtattcttgcaaaccaaaatttcaaatactagatagccgagagtctacagagggtcctttcaaactctattaagttacccttatcattttgctcattatgtctggctggctgctgtagttgtatgttctggcagcctctttcttgaccgaccagagatgaacagcatgaaattttattagcggcaggagaatgtaagagagctttttcaggtatatatatgtatcaattttatattccgtattgctgacatgagtaaaatatctgaatagttcttttgctt

SEQ ID NO: 287 - DNA, 333 bp, Musa acuminate
  misc_feature: exon 1
gcgatcgcccttctcttctgcgccggcgcggcgcccgcaacgaatcttgcagagagtaagaaggatcctcgcctttgtcaccaaacccttggtttccagggaggcgacatggaaggcggcgccgcgggagggcagcgagaccgggaaaccctggacgcggtgcggtcggtggtgtttaagccctccgtatccttggaggagaagcggttcccgagggtccaggggtacgacttcaaccggggttgtgacctcatcggcctcctcgattccatgtccactaccgggttccaagcttccaacctcggcgacgccatcgatgtcatcaatcagatg

SEQ ID NO: 288 - DNA, 128 bp, Musa acuminate
  misc_feature: intron 1
gtgagcccacgcccgtaggcccccctctggattcctgtagtttctgctgacgatcgccgcaagtatcggttcttggagataattttgttctttcttcccgttcgcttatcgtttgggacggaatgaag

SEQ ID NO: 289 - DNA, 168 bp, Musa acuminate
  misc_feature: exon 2
attgactggaggctctcccatgatgcgcccacggaagattgcagcgaggaagagcgcaatctggcctacaggcaatcggtcacgtgcaagatctttctgggcttcacttcgaaccttgtatcttctggcatcagggagataattcggtttcttgtgcagcaccgaatg

SEQ ID NO: 290 - DNA, 1173 bp, Musa acuminate
  misc_feature: intron 2
gtgagtgcatgtcattggcactattcttctttattcttgaaggtttaggttcaggttcttgggaagttcaacgcacaatacatcaagaacaccaaagaatatagaaccattccattcaatatttagttaccatttgatagggcatatttcagcaccacctacgtggcagcgaccagcagccacctcaagccgacatggtgcatccgtgccattgtggcacctcgagcttgtgcacgacgagaacccacacccgggggatcgatggccattaacgaactccatacgatcgaccctcgacaataggtataaaaatggatcccttggtcaatgccaaggggaaacgaaaacacactcgaattgaccgcaactccaccatactaacttaagcttatgagggggcacgaaaacacactcgaattgaccccaactccaccatactaacttaagcttcagagaggtcgagtcaggattttccttcccgaccctagcctgtctgctgcaacccagcaaggaaagaaaaacaactcccagtgcaacctcagatcagctcgacgaacagcgccctggcccctcctgacgccagccctctccagcccgagagccacgtggatgaccttgcacgtttggatcggaccgagccatgctgacgactcagtcatgacataaagttgtacaaacaccattaaagcaagactgaatctgtgattgtttttcttagtatgtcaagaaccctcgtgaatcctatattgatgccaacaaattcgacatgtttggcaggatctttaagatttatgcatttttcatggattcaagactgttctttctctaaatccaaaatattgaactttgaaccatctgaagtcagtttacatctaaacaaatggaccatatttttcttgttatttgcattctacctttatgcagtccactcttatttgttgattcttttctaatcttttctcaaaagaaatggaataagggactaaatttacaagacaacatgaaactgactttatcatatctcagttaaatttctgaagcactagatagtttgtatttctttactctaatgttttgctgcttctttagtaaaggttgtaatatatggtaggggctttctttatgcccatttatcaatgttcatttgctttaatagctttgtggcacgtctag

SEQ ID NO: 291 - DNA, 219 bp, Musa acuminate
  misc_feature: exon 3
gttgaagttttagtcacaactgctggcggcattgaagaagatttaatcaaatgccttgctcctacatataagggtgacttttctttgcctggatcgtatctgcgttcaaaaggattgaatcggataggaaaccttctggtccctaatgacaattactgcaaattcgaggactggatcatgccaattctggaccagatgttacttgaacagactacagag

SEQ ID NO: 292 - DNA, 1235 bp, Musa acuminate
  misc_feature: intron 3
gtaggactgatcatctttaagtttttgctactctatgctcctcaattgtcttttaattagcagacgaaaccttggcatgtcagttcctggcaagtgattcatattcttattgtactgatcattctctagcgctttcatgcaagtttttgtaggcatgattacttgttggccgtccaacttctgtagttattaatttcattgtcatatcatgcaggtcctgataaaattgacacaaggtttgacaacggtcatgtttttccaacaattgccaccatatgagacattaatgaatgctttattttatgatagagtattcttttttgttaaccttcttcgtgtgtgtgcatatctgtgctttgtgctttcccagactcacaaatggggccctagtgcatcaggctatctttggcaattataacagctctgagctacctcttgtacatgaatgcatagtagtttcatcatcttatctaattcacaataaccttgatatggctatgacataaagtagctgttgttgtgacttgtgagactgtagttagaaactgttatatgccatttcaataagtaatgctgttttactaggaggcaattgtttttttattatttttatctttgcctgtttaaataagttatattcttttatggcttaaaatttgcttagtgtattaaattgcatggagggaatgatgatgatctagtaaggccaagcttagatattaaaagatattttggtattttgaggattctgtttgaagaatgatggccagcttttctttaggcggggtttcacctgcttgggatgctgctgcttggatatgttgctcggcatatatttgtgtggcacttaattaaaatactggtaattgcagactaattaatggaactaaaacttatgtttgattttctgcttataattttatgtagtttcctttattatgaacaattccccttttagggttggatctttttatttatcaactgctattgattatattatcacagttaatgatctgcaaaacctgtacatatcctagactattttgtgaaaaatttaacatatttgtaaatttacatttgttttcttctaccagttttagtgtcatttagaacacaatactagattgcaattttgtagctctttcacatgcttgtttattcaggtattatcacaaatagaagtttgtagcacatattgttttctcacagaatgtgatatttgcttgtgctcacag

SEQ ID NO: 293 - DNA, 87 bp, Musa acuminate
  misc_feature: exon 4
aatgtagtttggactccatcaaaagtgattgcgcgccttggaaaagaaataaatgatgaaagttcatacctgtactgggcatacaag

SEQ ID NO: 294 - DNA, 785 bp, Musa acuminate
  misc_feature: intron 4
gtactagcagttattttcatctttttgctgccttgattgttttaaattactacaggttcaaacttattaacatgtggctattgtgtctaaagattgcttacctctatagctgtggcccttagtttttaatgacgtatatatttgtatgtataatatgtattttttagatgtcactacattgagaaacagatggtgattaatgaaattaagatgatgattgatcttctttcatcttaagctcgtgttttcttttctacatgctcagatctttatggtttcttccttgaagaattaagtcagggatgaaagtcaattcattgttattgattataatggtttcataatatatgtcaaactttgttgtatacattattatatactagatattttcattgttgtcgtatcttgtgccttatcatatccttttgtaacatgttgtttaattatccatgttgtgtcagcactccatgtcataccaatgattacaagtgttctttcgggtaattcagtataactttaattgcaacagtcagagcacttgacaactctgtaccatcaaacagtgttttgcttctttttcatgtagctctaggctttgcaattataaaagatgaatctataggaaagcagccagatgttttttctcgctaatttgagatagtccagcctgtgtatagaaaataatgatacttccttatttattctatccaatggtttatatttcatggttttgtatcagtatgttactctctatttattactaaaccttgttgcaatttgatcag

SEQ ID NO: 295 - DNA, 106 bp, Musa acuminate
  misc_feature: exon 5
aacaatgtttctgtctattgcccggcattgactgatggatcattgggggatatgttgtactgccattcagtgcggaatcctggtttacttattgatattgtgcaag

SEQ ID NO: 296 - DNA, 72 bp, Musa acuminate
  misc_feature: intron 5
gtacagccttttttgttactcaattgcttttgcctatttgcatcctgcttatgttgacatttcatcatccag

SEQ ID NO: 297 - DNA, 236 bp, Musa acuminate
  misc_feature: exon 6
acatacgagcaatgaatggagaagctatacatgtgggtctgagaaagactggggtcataattcttggtggggggctcccaaagcaccatatatgtaatgccaacatgtttcggaatggtgcagattatgctgtttatgtcaacactgcacaggaatttgatggaagtgattctggagcacagcctgatgaggcgatttcatggggaaagataaagggttctgcgaagactattaaa

SEQ ID NO: 298 - DNA, 3050 bp, Musa acuminate
  misc_feature: intron 6
  misc_feature (2003)..(2257): n is a, c, g, or t
gtatgtgtgctgatctttcttgtccaatcatttttctcctcttcttttccctttcaatatcatatacctattaataattacatgccctttctaggtcagacatgataagcctctttcactaatagtagtaagattagaaatataggttttcctaaaaatatgttgctttttaattgataaattacataatattttaggacatcatgaattttgtgtgatgagggtgggcctcggtagttagtagttgcttctttgtgacttgggagatcagggttcgagttacgaaaataatctctttaaatatataaatataagattgcatacattgacttgggagatcagggttcgagttacgagaatcttgtgcgttgggtacaccctttttagaagttttttgtaatcattaataccttttaattaagaggaaagttctacaagatcgttattagactagtgatattttatggatttgagcattggacaattaagaaatattgaggatgtgaactaatatgccatactatatgcttcactttttagagcagtttactctatgtcagaaagaattgatttgtatggggtttggggtcgatgatccatcgacttcataccatctttcgcatgaaagttttggtggaggagaaaactattgctggaaggccaagtgtaaaaacctaaaggaaaacaacatttattgtttgtaaagttaaaagtgttaattacaagacttgaaacaatggaataaaagtgtgatagaagactttggtctcttcctttctcattgctggaacatcctcctgaggtttgaatagtagacaacaggctttgggggcttctcaaagcagctggatggagcttgatgcagagcttcaactattggaacttgaggaagaaggttgcggttggaaggattggttgcacttcgtagaattcttcccttctcttctcctctcttctcttttgaggctggaacaactagggccggttggacacatgctggaggattcttggtttcccttgggctcccttaggtaggtctctcctccttttatagctgaggaaggggtgtagtcctagctaggttagaacttagagagtcctaatgccttaggtcttggagagtcctaatgccctttaggacttgttttagggctggcacatgagagtcctactcctattaggagttggcaccaccctctccttgtgactacccctatttgggcgagggctatcctaatcctagtcttagtaggactcgaattgaggcaagtgggctgctatgatatgatttcatggcttcaagaggcccttcaatagaggttggccaattttgtcttgtgctgttgagatcgtccctaatcaagaataagctctttgctctctttttctttgatttcatggcttcaagaggcccttcaatagttatctagatcttccacagttgcacgcatcatcaccaatttccttatagtgaaatgagaaattgtagaaggatgactcccaatccttcttgtactatggatttacggaaccatccttcgattaactaggaaacaaccatctttgaccaacatttttcttttccacaggatgcaacttcgttatctagattgttgggatgcagtattgatgtgtaattataaatttgggcttatgtatagagactctatatgaaagttagactaaatttaatgacaaacatatgaagtgcaatttaaataacaaaaatagaatatttgaagatataataaaaatagatggataaagcatttgtactagcaagtctttggagctgttattcgataggaaatgaagattgaaaagacacataaaacaagatgattggttaaatcagagaggagaatttagtctattatgtggtaatcatgtgattcttggatggaaagggcaactttaaggcattgctagtcttcgtctaccatatgaatttgataggattcacacacacacacacacacacatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatatatatatatatatggagttgctagaagagataagacaacaatatgtgcacctgtgaacaattaaagtagttctaattgatgataaagtagggaaaccgattaaggtggtttgaacacatgtggatgtatcagttagtcaaggacagaactcagattagtgctgctatgtgccatagaagacttcttggaacagtaggattgaatttgaggtcactttggcttttgtgttattgctacatcaatgatggaaaaagattgatgtttcaattctgatcagttgtgagtgtcattatactcgatgcaagattagttgacatgatttttgtggaaatttcaaattcttgattagtaaaatgaagaaggtagaattagatattctatcacaacatgacgcatagagaatattgtctaggactgattagctgtaagtgccaacagacctaaagcaagaggaaccacagttgtgctccactcttaaatgtggcagctgctcggaggacaagggaaacgattttttcaactgttgttgtgaataagatattaagttgaacactccactgtgcaccaatagggtatttgagattatgtttccatctacatgtatatattgcttcatgatctgaatgaagttattttctgtcttgtcaaaacaagttaggtgatatgaatggttagattctgaacattacctgtgttaagtttcacttttgtaattctaatgttgactaaaccaagcag

SEQ ID NO: 299 - DNA, 444 bp, Musa acuminate
  misc_feature: exon 7
gttcattgtgatgcaactattgcttttcctctattggtagctgcaacatttgcaagaaagtttcaggaaagaaacaacaaattagcctgatgggggtgcaaaaggtgatcatcttatttggattcaaataccctaatgtaatctgctaacatctgcagatgctgtattcttgcaaaccaaaatttcaaatactagatagccgagagtctacagagggtcctttcaaactctattaagttacccttatcattttgctcattatgtctggctggctgctgtagttgtatgttctggcagcctctttcttgaccgaccagagatgaacagcatgaaattttattagcggcaggagaatgtaagagagctttttcaggtatatatatgtatcaattttatattccgtattgctgacatgagtaaaatatctgaatagttcttttgctt

SEQ ID NO: 300 - DNA, 6158 bp, Manihot esculenta
ttaaataagattgtcctaaagaaggaaacgcagcttctcggcagagctcctttgcacgcacgccagagaaagtcgaacttggaactaggcaactagggttttggaggaggactttttctggttggcatcatagaacagtgagtaatgagtagtctgcatccactgctattgatttcttttgaatatcaattatctcaaatggaaccaatttctctgtatctttacagacaattaactttcctagtggtcaagagaattttctctagagattagtaagaatgattttatggttctagacaaggtagtgaaatgagattaagttgatgctgattattctgattcttggtgattgctgatgttgttaattaggtgtgagtgatgaacaatttgatggtagtctctttaccattcaatcaattgctcagcctctgttttattaaattcttcaatgggatggtctgcttattttggagatatttccatttggaagttctgttgactgttctgatcctggatatttgttccttaattacatctctgttcaatgtatggaacttatgttattggttaagtattaagtaaatggaagtctcaatctgatttggttttaacagttgcatatgaatatttcttcacctatatcttatggacgcaaggttctctttcttgatttaagctgttcattacctttcaatataaaaattggctcaaataggtgcatgaagctcctgaattatgggaacatgtattactatcatttcaaattggtgttacgtatttttctacttgacattatcttaattttccctgtggtcatatttgaaatttgctgcctttgttcactgaggcaggtatagtatggacatattgcttttctaatttttcaaaattgtttatgctttttgtcatgttttggtattaatctgattttatttaggtcctttgtgtgttatttggtggagttgggcataaattgtttgaaacttgaaagatccttattacttttccaaattttcaagcattttttaatctttcttttctttaaatttattttccattttcttcttttttgttgaattccatattaatatgccaaattcagttttgtttaatctatttgtcaaaaaaaaagaaaaaatccactgccctccgaaaaacctaccattaatgccttcattcttgcaacaactgccacttcctatctgcaatcccaagaaatttcaagcaaagagaatcaaaatttagcttgttggtgtcactgtgatccttctgcagctaggctttatttttttccaaaggttgatggaggagcaattgccatcatctgtacataccatagttttcaaagagtctgaaccccttgaagggaaatgcatcaagattgaaggatatgattttaatgaaggagttaactactctcagcttctgaaatccatggtctccactgggtttcaagcatccaaccttggtgatgccattgcagttgttaaccagatggttagtttcagttattgaaattttatctttttcctttcatgtgatacgaggtgatgtatgttagtgttctacttgcataaattgttattaattcttttttcaaaatattggatgtggaaatgaagctagactggaggcttgctgatgaggatataacagaagattgcaatgaggaggaaagggaccctgcttatagagagtctgtgaaatgcaaggttttcttgggttttacctcaaatcttgtatcttctggtgttagagatacaattcgctatcttgttcagcatcatatggtgagaaattgatgttttaatatgatcatatattatattttatgttttgatctaataatttaaagcctgaactctttgtttttttttttttttttgagagatttaaagccacttaatagtagtatttatggattttgttggtttaaatacttaaaaaaggactcaacccatggaaacctgtttagtttatatggagttatgtgaatctttacaatcaaagacaaagaagagtgagccaaaattttattttattaatttgatttgatcatcttctgctggatgcgagacaagaggaaaattttagatgcaaaatagaaaaattttaaaaaatttttgcttgttagtaatttgatgaattcttctcatggtgctggatttgagaagatgggaaagaaagtgcacatgcaaaggagtcattgaaactttttcatggttagtaatttgatgagttctgctctaagtggtggtcttgaaaagaggaacaaatatacatggtcctgcattgcagtttctcctttcttatcttctggcagctccttaaatacagctttctttttatttcttgtttttcctctgtgttgctattaaaaatgttttgagctgctctactatagtagtaaaattattctgactatctaggaatgcttcataatgagagagtctatgtctaaagctttaatactggacaactggcgaagcctctgatcaaatgtcatcctgtctaacaattttacatcaaactttggctgtgattcatgtaatagtttaggcggtccaaccttttaattagatttgccacatatctcaactacataaaatgaaagaactgtttataatgtgactgcaggttgacgtagtggttacaactgctggtggcatagaagaagatcttataaaatgccttgcccccacatacaaaggtgacttttatctacctggagctcaattgcgttcaaaaggattgaaccgcattggtaacttgttggttccaaatgacaactattgcaaatttgaggactggatcattccaatttttgaccagatgttgaaggaacaatttgaagaggtgcttctttcataacaaatatgtgcctttcacttactgtgttcattttccattattttcttgaggtgtctgtcccagtgttgatgcgtgcatatgagagagagggagagattatcttctatccatactgactaataaaaataggagatgagaactattcaattttgtgttaattctcaaaattgttaatacataataaactctactgaaatacctagaggatataggtacctagttttgtaatcctactagttttatgatttggatacggtaaaagaaaatactaataagataccaatcagtaaaacgaaacaaactctaactttctagttgaaatataacactaattcggtaattcctaataataaataatatgtaaacttcctaatactaaataagcatcaccgatcattgctgcacaggtggaatgtttacaaagccacacatttcccttttgtttttattttactttgtacgagaagatcacatcatttttctcatatcttcattgggattttacagaatgtttcatggacaccatctaaagtaattagtcgactgggaaaagaaataaatgatgagtgttcatacctttattgggcatacaaggtaagtgttgaacgagcccatttctctcctcattttgtttaagattttattattgttattatattattctcattgagcatatttgccctcttttttttgttattatttcattgtttctcataattactgttttgcatctcacaaccatttggatttgttccttttatgttatggaaaatgatagttgaatagctattcaattcttttgtagacatggtttgaagtcttgattagcctcttcttttttttttctttttttttttcctgaaaataatattacttatggttattttgagcatctagattatgctttaagcaatttgtaactcaaaaggttatgctatcagtcaaacaagttcttcttgtattatacattatggaccttgcctcacttgcatcatccttgttaattttggtactccaatgtataatttgcatagagttggataagtagagttggataagtagcgttgtacaaacattcagaaacacttcaatattgtagtttgttcaatgggtataagtataatcactagataggtattgcaaaatcataattaatcaggaatgggaggaacaaataaaagaagttttcacttccattacattactagcttttaggtttgaatagcaagctgtgctgcagcaaaagatatagaaactgtatgcgctattatgtgtcttctaaattctcctttgggtttaggattaattatatcaagataattgacatttaaaggcaacacaagcagagttgtctatatcaaaagggttgctgtcaattggaacttgcctcatttgcaacatccttcctaagtttggtatgcaatgtctaatttgcatagagttggataaagagtgttgcaaagacattcaaaagcacttcaatgatgtagtttattcagtgagtataatgactggatagatattgtaaaattcataattaatctggaacggaaggaaaagaaataaaaagtttgtacttctacttgtagcttttaggtttgaatagtaagctgtgctgcagcagaggatatagaaactgtgtgctataatctgtctactaaattctcctttgggtttaggattgatcgtattgagataaataacattaagtgcaaaagggcagagttctctgtatcatttgtagcgttacaagtttactgcaatggtgaatgtcttggtcttgctaccaagagttcttaggtttttaggcttgaatgaagccacttgtgctaaatttttgaacaatcaaaattctctgttagagtttgcttcactaaatcactcattgatgggcctgctttgagctttcaaataggagtcctgcactcctgctacaaattaatcccctaaaatccttaggcgcagctcactgcatcatatctggtcaaagttttgaccaaagatagaggtgggtagcttttgtatatgaaaatgtaggtgtttaggcaagataatggctttggccttgtcattattatttttattgcaacctttaaaaatactttaacattcttttggataatttgcagaacaacattccagtattttgtcccggtttaacagatggttctttgggggacatgttatactttcactcctttcgcagcccaggcctaattgttgacattgtacaaggtattttcctgctgcactgcaattttgttatgctagttaccaatacgggatggatataaagatcttaataagtggcttttggacagacattagagccatgaatggtgaagctgtccatgcaagtcctagaaagactggaatcatcgtacttggaggggggcttcctaagcatcatatatgcaatgccaatatgatgcgtaatggtgcagattatgctgtttttatcaatactgcacaagaattcgatgggagtgattctggtgctcgtcctgatgaggctgtatcatggggaaaaattcgaggatctgctaaaactgtcaaagtacgactatttgttcctcctttttatttttgcatgcatcctttttttccagcttctgctattatcagcagttgtactatatgtcataccagaatatcaaccacaagttttacagcttcatgctatttttctttatgcgataggcgtttctgttaaagaggtttttgtgtgagatgaatgttgatgtttaataatcgttgttggtggcttattgcaatgagtttgtgatttaattattctcccttccttcaaattgcaaccaggtacattgtgatgcaaccattgcttttcccctactggttgctgaaacttttgcctcaaagagaaacagatccgtcaagatcaaggtaaacaattattaaccatccttctggtggtgagttaagtgagatcaattactaatttgaatcatttcgggggaaccacttatagtttagaattagacacctctattggaagagaggatttttggatgtcaacgatggttggtgcttggtaagttagacattttagattactttgagggacatttccccccttctattgatgaagtttaaagcgaagctgggtttgcttcataacgctgttcaaatacttacccttggtggccaaggagagcagggacatgacatttattgtaataattgtaagaactttaatttatttaggaaatctgtgaaacatttattcatcatacaatcaaaagagtagttatttttttgaccctaaa

SEQ ID NO: 301 - DNA, 137 bp, Manihot esculenta
  misc_feature: exon 1
ttaaataagattgtcctaaagaaggaaacgcagcttctcggcagagctcctttgcacgcacgccagagaaagtcgaacttggaactaggcaactagggttttggaggaggactttttctggttggcatcatagaaca

SEQ ID NO: 302 - DNA, 137 bp, Manihot esculenta; identical to SEQ ID NO: 301
  misc_feature: intron 1

SEQ ID NO: 303 - DNA, 222 bp, Manihot esculenta
  misc_feature: exon 2
ctaggctttatttttttccaaaggttgatggaggagcaattgccatcatctgtacataccatagttttcaaagagtctgaaccccttgaagggaaatgcatcaagattgaaggatatgattttaatgaaggagttaactactctcagcttctgaaatccatggtctccactgggtttcaagcatccaaccttggtgatgccattgcagttgttaaccagatg

SEQ ID NO: 304 - DNA, 125 bp, Manihot esculenta
  misc_feature: intron 2
gttagtttcagttattgaaattttatctttttcctttcatgtgatacgaggtgatgtatgttagtgttctacttgcataaattgttattaattcttttttcaaaatattggatgtggaaatgaag

SEQ ID NO: 305 - DNA, 168 bp, Manihot esculenta
  misc_feature: exon 3
ctagactggaggcttgctgatgaggatataacagaagattgcaatgaggaggaaagggaccctgcttatagagagtctgtgaaatgcaaggttttcttgggttttacctcaaatcttgtatcttctggtgttagagatacaattcgctatcttgttcagcatcatatg

SEQ ID NO: 306 - DNA, 847 bp, Manihot esculenta
  misc_feature: intron 3
gtgagaaattgatgttttaatatgatcatatattatattttatgttttgatctaataatttaaagcctgaactctttgtttttttttttttttttgagagatttaaagccacttaatagtagtatttatggattttgttggtttaaatacttaaaaaaggactcaacccatggaaacctgtttagtttatatggagttatgtgaatctttacaatcaaagacaaagaagagtgagccaaaattttattttattaatttgatttgatcatcttctgctggatgcgagacaagaggaaaattttagatgcaaaatagaaaaattttaaaaaatttttgcttgttagtaatttgatgaattcttctcatggtgctggatttgagaagatgggaaagaaagtgcacatgcaaaggagtcattgaaactttttcatggttagtaatttgatgagttctgctctaagtggtggtcttgaaaagaggaacaaatatacatggtcctgcattgcagtttctcctttcttatcttctggcagctccttaaatacagctttctttttatttcttgtttttcctctgtgttgctattaaaaatgttttgagctgctctactatagtagtaaaattattctgactatctaggaatgcttcataatgagagagtctatgtctaaagctttaatactggacaactggcgaagcctctgatcaaatgtcatcctgtctaacaattttacatcaaactttggctgtgattcatgtaatagtttaggcggtccaaccttttaattagatttgccacatatctcaactacataaaatgaaagaactgtttataatgtgactgcag

SEQ ID NO: 307 - DNA, 219 bp, Manihot esculenta
  misc_feature: exon 4
gttgacgtagtggttacaactgctggtggcatagaagaagatcttataaaatgccttgcccccacatacaaaggtgacttttatctacctggagctcaattgcgttcaaaaggattgaaccgcattggtaacttgttggttccaaatgacaactattgcaaatttgaggactggatcattccaatttttgaccagatgttgaaggaacaatttgaagag

SEQ ID NO: 308 - DNA, 522 bp, Manihot esculenta
  misc_feature: intron 4
gtgcttctttcataacaaatatgtgcctttcacttactgtgttcattttccattattttcttgaggtgtctgtcccagtgttgatgcgtgcatatgagagagagggagagattatcttctatccatactgactaataaaaataggagatgagaactattcaattttgtgttaattctcaaaattgttaatacataataaactctactgaaatacctagaggatataggtacctagttttgtaatcctactagttttatgatttggatacggtaaaagaaaatactaataagataccaatcagtaaaacgaaacaaactctaactttctagttgaaatataacactaattcggtaattcctaataataaataatatgtaaacttcctaatactaaataagcatcaccgatcattgctgcacaggtggaatgtttacaaagccacacatttcccttttgtttttattttactttgtacgagaagatcacatcatttttctcatatcttcattgggattttacag

SEQ ID NO: 309 - DNA, 87 bp, Manihot esculenta
  misc_feature: exon 5
aatgtttcatggacaccatctaaagtaattagtcgactgggaaaagaaataaatgatgagtgttcatacctttattgggcatacaag

SEQ ID NO: 310 - DNA, 1535 bp, Manihot esculenta
  misc_feature: intron 5
gtaagtgttgaacgagcccatttctctcctcattttgtttaagattttattattgttattatattattctcattgagcatatttgccctcttttttttgttattatttcattgtttctcataattactgttttgcatctcacaaccatttggatttgttccttttatgttatggaaaatgatagttgaatagctattcaattcttttgtagacatggtttgaagtcttgattagcctcttcttttttttttctttttttttttcctgaaaataatattacttatggttattttgagcatctagattatgctttaagcaatttgtaactcaaaaggttatgctatcagtcaaacaagttcttcttgtattatacattatggaccttgcctcacttgcatcatccttgttaattttggtactccaatgtataatttgcatagagttggataagtagagttggataagtagcgttgtacaaacattcagaaacacttcaatattgtagtttgttcaatgggtataagtataatcactagataggtattgcaaaatcataattaatcaggaatgggaggaacaaataaaagaagttttcacttccattacattactagcttttaggtttgaatagcaagctgtgctgcagcaaaagatatagaaactgtatgcgctattatgtgtcttctaaattctcctttgggtttaggattaattatatcaagataattgacatttaaaggcaacacaagcagagttgtctatatcaaaagggttgctgtcaattggaacttgcctcatttgcaacatccttcctaagtttggtatgcaatgtctaatttgcatagagttggataaagagtgttgcaaagacattcaaaagcacttcaatgatgtagtttattcagtgagtataatgactggatagatattgtaaaattcataattaatctggaacggaaggaaaagaaataaaaagtttgtacttctacttgtagcttttaggtttgaatagtaagctgtgctgcagcagaggatatagaaactgtgtgctataatctgtctactaaattctcctttgggtttaggattgatcgtattgagataaataacattaagtgcaaaagggcagagttctctgtatcatttgtagcgttacaagtttactgcaatggtgaatgtcttggtcttgctaccaagagttcttaggtttttaggcttgaatgaagccacttgtgctaaatttttgaacaatcaaaattctctgttagagtttgcttcactaaatcactcattgatgggcctgctttgagctttcaaataggagtcctgcactcctgctacaaattaatcccctaaaatccttaggcgcagctcactgcatcatatctggtcaaagttttgaccaaagatagaggtgggtagcttttgtatatgaaaatgtaggtgtttaggcaagataatggctttggccttgtcattattatttttattgcaacctttaaaaatactttaacattcttttggataatttgcag

SEQ ID NO: 311 - DNA, 106 bp, Manihot esculenta
  misc_feature: exon 6
aacaacattccagtattttgtcccggtttaacagatggttctttgggggacatgttatactttcactcctttcgcagcccaggcctaattgttgacattgtacaag

SEQ ID NO: 312 - DNA, 86 bp, Manihot esculenta
  misc_feature: intron 6
gtattttcctgctgcactgcaattttgttatgctagttaccaatacgggatggatataaagatcttaataagtggcttttggacag

SEQ ID NO: 313 - DNA, 236 bp, Manihot esculenta
  misc_feature: exon 7
acattagagccatgaatggtgaagctgtccatgcaagtcctagaaagactggaatcatcgtacttggaggggggcttcctaagcatcatatatgcaatgccaatatgatgcgtaatggtgcagattatgctgtttttatcaatactgcacaagaattcgatgggagtgattctggtgctcgtcctgatgaggctgtatcatggggaaaaattcgaggatctgctaaaactgtcaaa

SEQ ID NO: 314 - DNA, 263 bp, Manihot esculenta
  misc_feature: intron 7
gtacgactatttgttcctcctttttatttttgcatgcatcctttttttccagcttctgctattatcagcagttgtactatatgtcataccagaatatcaaccacaagttttacagcttcatgctatttttctttatgcgataggcgtttctgttaaagaggtttttgtgtgagatgaatgttgatgtttaataatcgttgttggtggcttattgcaatgagtttgtgatttaattattctcccttccttcaaattgcaaccag

SEQ ID NO: 315 - DNA, 467 bp, Manihot esculenta
  misc_feature: exon 8
gtacattgtgatgcaaccattgcttttcccctactggttgctgaaacttttgcctcaaagagaaacagatccgtcaagatcaaggtaaacaattattaaccatccttctggtggtgagttaagtgagatcaattactaatttgaatcatttcgggggaaccacttatagtttagaattagacacctctattggaagagaggatttttggatgtcaacgatggttggtgcttggtaagttagacattttagattactttgagggacatttccccccttctattgatgaagtttaaagcgaagctgggtttgcttcataacgctgttcaaatacttacccttggtggccaaggagagcagggacatgacatttattgtaataattgtaagaactttaatttatttaggaaatctgtgaaacatttattcatcatacaatcaaaagagtagttatttttttgaccctaaa

SEQ ID NO: 316 - DNA, 4441 bp, Medicago sativa
tataacaaacggtccgaccggatccaagttgcaccggttcgaaccgctttagttactactaacggttcgaaccgttatttttcaacccgtgacaaacgtggaaggcttcgttgtttcttcttcttcttcttcttcttattaattaccatgcgtttttgtttttcttttgagtcattgaagtcttgttttttgtcgtgtttctgtcttgagaccgtgaaagagaaaacaaagagtacgagaatgagtgaaacaaagcaagaagatgatacaattatgtcctcagttcactccactgtcttcaaagaatccgaaaatctcgcaggaaagtgtgtccaaatcgagggttatgatttcaaccgcggcgtcgattatcaacagcttctcaaatcaatgctcacaactggttttcaagcttccaactttggtgatgccgttaaagtcgttaatcaaatggtaatttttctaaatttaatactaacccatctttgttttttatatatttttcaattttgcttataaagttttttcctttgtgtttttttggaacatgggttgaagctagattggaggttggttgatgaaccaattgatgaggattgtgatgaagataagaaggatttggagtataggaaatctgttacatgcaaagtgtttttgggtttcacttctaatcttatctcttctggtgttagagatgttgttcgttacctttgtcagcatcacatggtgagtgtgtttttttggtttaatttgtcattaactcattctcattctgattatgtatttgctaatctaaatggccactgacaaaagtttttaatttcaccctaagctaattgctcttgaattcattggattgttttgggggttgggtaactcaactagtttgagctaaggtcccaagtttaaaaatctgggtgaaggagaaaaatactaatctaaattactaccattgacctttgaaaaaaaaaaagacgaatataggatggtgtggagcaaaaactgttaatatctttcttcagattaggtctttagtgttgaattcaatatgcgaatgttttagcatcataattatggaatttgctactgtggatatctttgccttgttttgattgcataggggcttttgtgttttatataggtctattggctggtgttagttaaaatctgtgatattgaaggcaagcaagtctttatgtcatatgtcttatgctatataggcttttattttggttggctgcacttgatgaaatcttgttgaatattgtaatttttctcatatatgccttatgctttgggttacgattattatatgaatgtatcttttccttttaaaaaaaataaaaacatctgaaatgttgtagtgtcaccatcaactaagaacatggaagccggtgaagcttcgggttaattttggaatatgtgggtgctgttagataatctcaaatggggtttacatgttcaaactttgatgttgaactttaaatttatgcaatatcaagtcagggggttagttaatgtgcaaagagtcgaaatttccgatttcgctgtgtttgctcagtttttcaccatggcttggctgatttcatctagtttttcaccatgcttaatcgccaagcgactcgacactgtcactaagctaatttccttgaatttcttatatgttgcttgtcacttagggaagaacaagatttgcttaccaaattcagtttcttctttcccactgattttcatagtgatggaattataaaattttctagttttaatctactctgcgtgcgtgtgtagaaatacgatagacaagattatgcatgactatgagctagtatatacatgtataaaggtatatgggtgatgtttccttcctagcttaggtgttacaccaagtatagtatattaggtcaagcatgaaaatattgtaatgtgagattgcctattgcaatttccttttactagatgtatttgaagatcctggtgggtttaatgaagctgtgatatagcttatatatatatatatattttttttttttggtgatacagcttatatttattgaattggaagctcgctaaaccaagtgttttttttttttttttttaattttgtgaatgacatggtagtcttgttattatttttgttgcatctgttctacaggttcatgtagttgttacaactacaggtggtattgaagaagatcttataaagtgccttgcaccaacatataaaggagagttctctttgcccggagcttatcttcgctcaaaaggattgaatcgaatcggtaatttattggtccctaatgaaaattattgcaaatttgaggactggattattcctatttttgatcaaatgttgaaggagcaaaaggaagaggtattttattttttacttttcccttattacaaaaattattatatggttcagtttttgtgaaggtaatcaaaaccggatggtttgactgggaaccagacctatgtttggttcggaagactccgagtaccggtggtttgagggttggacctttttaaaaaaaaaaatgtaaaaatctgctctaaatttttaattttttccttttattaccaccttgaaaatcttaattagttatctcctttaagcaatgtggaacttcatgaagtattttgttcaccataaaagtcttgatttattgtagaaagtctaggtctctcttttaaacaatgttggacttaaaaaagtagacagtacatttgtaggaaaggaattaccggcagagaaaggttgagtaaaattacgaacaaatgaaaatatagttggaaaaaaatattgtttaattatgggtccaacactgagcagaccattaaaccttgaatcagcaactacagcgattcaatgttcggtccgattttagataccttgtttttttgttgatgcctggagtcacatttagtggtcatgctaattatatttgaatacacttattctgctggaaaaagaacctcttatgaaggaggttcttttttagttttcactaaacttttttccctgtcacttcagtttttttttttttttaattggcagaaagtgctgtggacaccgtctaagttaatagctcgattgggaaaagagatcaacaatgaaaactcctacctttactgggcatataaggcaagaatgatatcaagtttaatttcagcaaaatatattgttctctacttcgtttctgattcaaatctttacactagtttctttttcgatagttatgctgttaattttctagatatcttgcattgtgttacatacagaatgcaacatggttatatgtattgattttcttatttacttaataactggagtatcagaaaattgcacataatataataccattgatatttttttggtgttttgcagaacaatattccagtttattgtccaggattaaccgatggctcactgggtgacatgctgtacttccattccttccacaaccctggtctgattgtggacatagtgcaaggtttttactccattcttttttactctactgcatggatgattttgaaacaatttgaatcataactaaaataattggcaatgcaacagatataagggccatgaatggtgaagctgtacatgcaaatcctagcaagacgggcatgattattttaggaggcggccttccaaaacatcacatttgcaatgccaatatgatgcgcaatggtgcagactatgcggtttttattaatactgcacaagaatttgatggaagtgattctggagctcgtccagatgaggctgtttcatgggggaaaatacgaggatctgctaaaactgttaaggtacatcctatatactttcactacttgttttctttacagaatactctaaacttttgctgtattttatcccttaaaactatgtttctttatttcactaaaccaggtacattgtgatgcaacgatagcattccctctgctggttgctgaaacatttgcctcaagaacgtcaccccttaattgataaaggtccaccgtcaaaagtaaaaggtgtggctgggaagtgttttaccgcagctccacttgtgagtgccaaatgttttggtatgtaacttataagaccaaggtcggctgtatgtcatacttgagttgaggtcaaagttcatttgcaatgcagtgtgtttgaggatcttgatggaccagtttgccattgacttttaatttgactgtcttgttattcgcaaggtccacataacaagcatttttaccatttagaaacaatttattagtcctgaaggaattgagagtcatgaattcagatgtaaattatgcaatgctaactatatttttttggaactgtggtttctcttagatttgaggtgttgaaaacactgtaatatctagagcaaataagactagaaaagtttatcaactattactgatcagttatagtatcttcaatattttccaa

SEQ ID NO: 317 - DNA, 129 bp, Medicago sativa
  misc_feature: exon 1
tataacaaacggtccgaccggatccaagttgcaccggttcgaaccgctttagttactactaacggttcgaaccgttatttttcaacccgtgacaaacgtggaaggcttcgttgtttcttcttcttcttc

SEQ ID NO: 318 - DNA, 315 bp, Medicago sativa
  misc_feature: intron 1
  misc_feature: exon 2
ttaattaccatgcgtttttgtttttcttttgagtcattgaagtcttgttttttgtcgtgtttctgtcttgagaccgtgaaagagaaaacaaagagtacgagaatgagtgaaacaaagcaagaagatgatacaattatgtcctcagttcactccactgtcttcaaagaatccgaaaatctcgcaggaaagtgtgtccaaatcgagggttatgatttcaaccgcggcgtcgattatcaacagcttctcaaatcaatgctcacaactggttttcaagcttccaactttggtgatgccgttaaagtcgttaatcaaatg

SEQ ID NO: 319 - DNA, 105 bp, Medicago sativa
  misc_feature: intron 2
gtaatttttctaaatttaatactaacccatctttgttttttatatatttttcaattttgcttataaagttttttcctttgtgtttttttggaacatgggttgaag

SEQ ID NO: 320 - DNA, 168 bp, Medicago sativa
  misc_feature: exon 3
ctagattggaggttggttgatgaaccaattgatgaggattgtgatgaagataagaaggatttggagtataggaaatctgttacatgcaaagtgtttttgggtttcacttctaatcttatctcttctggtgttagagatgttgttcgttacctttgtcagcatcacatg

SEQ ID NO: 321 - DNA, 1426 bp, Medicago sativa
  misc_feature: intron 3
gtgagtgtgtttttttggtttaatttgtcattaactcattctcattctgattatgtatttgctaatctaaatggccactgacaaaagtttttaatttcaccctaagctaattgctcttgaattcattggattgttttgggggttgggtaactcaactagtttgagctaaggtcccaagtttaaaaatctgggtgaaggagaaaaatactaatctaaattactaccattgacctttgaaaaaaaaaaagacgaatataggatggtgtggagcaaaaactgttaatatctttcttcagattaggtctttagtgttgaattcaatatgcgaatgttttagcatcataattatggaatttgctactgtggatatctttgccttgttttgattgcataggggcttttgtgttttatataggtctattggctggtgttagttaaaatctgtgatattgaaggcaagcaagtctttatgtcatatgtcttatgctatataggcttttattttggttggctgcacttgatgaaatcttgttgaatattgtaatttttctcatatatgccttatgctttgggttacgattattatatgaatgtatcttttccttttaaaaaaaataaaaacatctgaaatgttgtagtgtcaccatcaactaagaacatggaagccggtgaagcttcgggttaattttggaatatgtgggtgctgttagataatctcaaatggggtttacatgttcaaactttgatgttgaactttaaatttatgcaatatcaagtcagggggttagttaatgtgcaaagagtcgaaatttccgatttcgctgtgtttgctcagtttttcaccatggcttggctgatttcatctagtttttcaccatgcttaatcgccaagcgactcgacactgtcactaagctaatttccttgaatttcttatatgttgcttgtcacttagggaagaacaagatttgcttaccaaattcagtttcttctttcccactgattttcatagtgatggaattataaaattttctagttttaatctactctgcgtgcgtgtgtagaaatacgatagacaagattatgcatgactatgagctagtatatacatgtataaaggtatatgggtgatgtttccttcctagcttaggtgttacaccaagtatagtatattaggtcaagcatgaaaatattgtaatgtgagattgcctattgcaatttccttttactagatgtatttgaagatcctggtgggtttaatgaagctgtgatatagcttatatatatatatatattttttttttttggtgatacagcttatatttattgaattggaagctcgctaaaccaagtgttttttttttttttttttaattttgtgaatgacatggtagtcttgttattatttttgttgcatctgttctacag

SEQ ID NO: 322 - DNA, 219 bp, Medicago sativa
  misc_feature: exon 4
gttcatgtagttgttacaactacaggtggtattgaagaagatcttataaagtgccttgcaccaacatataaaggagagttctctttgcccggagcttatcttcgctcaaaaggattgaatcgaatcggtaatttattggtccctaatgaaaattattgcaaatttgaggactggattattcctatttttgatcaaatgttgaaggagcaaaaggaagag

SEQ ID NO: 323 - DNA, 684 bp, Medicago sativa
  misc_feature: intron 4
gtattttattttttacttttcccttattacaaaaattattatatggttcagtttttgtgaaggtaatcaaaaccggatggtttgactgggaaccagacctatgtttggttcggaagactccgagtaccggtggtttgagggttggacctttttaaaaaaaaaaatgtaaaaatctgctctaaatttttaattttttccttttattaccaccttgaaaatcttaattagttatctcctttaagcaatgtggaacttcatgaagtattttgttcaccataaaagtcttgatttattgtagaaagtctaggtctctcttttaaacaatgttggacttaaaaaagtagacagtacatttgtaggaaaggaattaccggcagagaaaggttgagtaaaattacgaacaaatgaaaatatagttggaaaaaaatattgtttaattatgggtccaacactgagcagaccattaaaccttgaatcagcaactacagcgattcaatgttcggtccgattttagataccttgtttttttgttgatgcctggagtcacatttagtggtcatgctaattatatttgaatacacttattctgctggaaaaagaacctcttatgaaggaggttcttttttagttttcactaaacttttttccctgtcacttcagtttttttttttttttaattggcag

SEQ ID NO: 324 - DNA, 87 bp, Medicago sativa
  misc_feature: exon 5
aaagtgctgtggacaccgtctaagttaatagctcgattgggaaaagagatcaacaatgaaaactcctacctttactgggcatataag

SEQ ID NO: 325 - DNA, 243 bp, Medicago sativa
  misc_feature: intron 5
gcaagaatgatatcaagtttaatttcagcaaaatatattgttctctacttcgtttctgattcaaatctttacactagtttctttttcgatagttatgctgttaattttctagatatcttgcattgtgttacatacagaatgcaacatggttatatgtattgattttcttatttacttaataactggagtatcagaaaattgcacataatataataccattgatatttttttggtgttttgcag

SEQ ID NO: 326 - DNA, 106 bp, Medicago sativa
  misc_feature: exon 6
aacaatattccagtttattgtccaggattaaccgatggctcactgggtgacatgctgtacttccattccttccacaaccctggtctgattgtggacatagtgcaag

SEQ ID NO: 327 - DNA, 86 bp, Medicago sativa
  misc_feature: intron 6
gtttttactccattcttttttactctactgcatggatgattttgaaacaatttgaatcataactaaaataattggcaatgcaacag

SEQ ID NO: 328 - DNA, 236 bp, Medicago sativa
  misc_feature: exon 7
atataagggccatgaatggtgaagctgtacatgcaaatcctagcaagacgggcatgattattttaggaggcggccttccaaaacatcacatttgcaatgccaatatgatgcgcaatggtgcagactatgcggtttttattaatactgcacaagaatttgatggaagtgattctggagctcgtccagatgaggctgtttcatgggggaaaatacgaggatctgctaaaactgttaag

SEQ ID NO: 329 - DNA, 103 bp, Medicago sativa
  misc_feature: intron 7
gtacatcctatatactttcactacttgttttctttacagaatactctaaacttttgctgtattttatcccttaaaactatgtttctttatttcactaaaccag

SEQ ID NO: 330 - DNA, 443 bp, Medicago sativa
  misc_feature: exon 8
gtacattgtgatgcaacgatagcattccctctgctggttgctgaaacatttgcctcaagaacgtcaccccttaattgataaaggtccaccgtcaaaagtaaaaggtgtggctgggaagtgttttaccgcagctccacttgtgagtgccaaatgttttggtatgtaacttataagaccaaggtcggctgtatgtcatacttgagttgaggtcaaagttcatttgcaatgcagtgtgtttgaggatcttgatggaccagtttgccattgacttttaatttgactgtcttgttattcgcaaggtccacataacaagcatttttaccatttagaaacaatttattagtcctgaaggaattgagagtcatgaattcagatgtaaattatgcaatgctaactatatttttttggaactgtggtttctcttagatttgaggtgttgaaaa

SEQ ID NO: 331 - DNA, 80 bp, Medicago sativa
  misc_feature: exon 9
ctgtaatatctagagcaaataagactagaaaagtttatcaactattactgatcagttatagtatcttcaatattttccaa

SEQ ID NO: 332 - DNA, 4344 bp, Oryza sativa Japonica
tggcggcgccgccggccgcccccacctcaccttccgccgcctttgcctcccgctttctccaagcgcggcagcgccgccgccgccgccgccccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggaggagggggagtgcgcgacatggacgcgctggagggcgtgcgctcaatcgtgttgaagccctcggagtccctcgacgaggggcggttcacgaggatcgccggcgccgacttcaacgacgccggcctcggcctccccgggctgctcgcgtcgctcgccaccaccggattccaggcctccaacctcggcgacgccgtcgacgtcgtcaaccagatggtacgttactaattactgcaccctttgcagccttcctgccttttgcatgcccgtgagggaggcgaagcggatttgggggttactgtagcttgaaattgttgtgtttctagatccttggagtttcttaggaattgcaatttagacgaggcccattgctgtagctgtgttggtgtaattggagctgaagaggtgaagtcatgtgctgaatgatgcgatagatgtggttgctataaaatcggaaacttgcagcttattattcatgctagggttgacactctactgatgattatctcgataattcctgtcagatgaaacagttagcaaatttgaaatggtgtaggtgtataaaaaatgctaccaaatttacttatttacattgtgaatttattggacaactccaaatgtacacttgaacttcctcgtaagtgatctggaggtaatccagatgaaaaattatgaaaaaaaactctctgttaccatcttacatgtgtgttccacgattttccactttaacatttccatgatattttttaacacctttaagatgttctgatactccctaaccctttctattctgttcttgaatgcactgaagttagattggaggctgtctcacgagaagccacgtgaggactgtgatgaagctgagcttgatcctacatatagagaatctgtaaagtgcaaaatattcctgggattcacttcaaaccttgtctcttctggcattcgagatgtagtccgttttctagttcagcatcacatggtgagaatcgcgttgctgtaatttccttttatgacctggtttggtagagatggttttacatgcttttggtaacatactagcattatcaaaagcattgatatcttatccctatgatgtagctaatcccccttgaaaaatgtgttatttaggtggatgttattgttacaactgctggtggtatagaggaggatctcatcaaatgtcttgctcccacttatagaggagaattttctttacctggaacactgttgcggtcaaagggattgaatcggattggaaatcttttggttcccaatgataactattgcaagtttgagaactggatcatgccactttttgatcagatgctacaagagcaatccactgaggtactgttacatttttcttctggctgaagcgcagataacttgcagcaatgtgttcaacactatataatgcacatgtgcttatgattcattagctgtatagaggaggaatcatgtattgggcagtaatataaaatgacctagcttagagtgcttagaactccactagtattatggtacagaatgttcaaaaataagaaacatgagagaaaaaacttaaatggaaagcagctataatctgccccacaagtactcccaaataataaattaaaatatgttgaatttcaatgctacaggaataaaaaggatctatgcacattatttgaaccagccttcattagctccctttcaaattggtccgtgttttattaacctagtaatgatacacgcacaaatccaaataaaactgacatatgaggacaccaactatgaatttctgtagctttactgctgtgcccttgttttccaactatcaattatcagatacatcttttctctcagaagcaactcttccaactacttttgtgctctctctcctgttcatgaagtacgatcaattttacttacctgcagaatgtttggacaccatcgaaggtcatagcttgtcttggcaaagaaataaatgatgaaagttcctacctttattgggcgtataaggtaacacatgtttattaactacacctgaatatccttacaaagtgcaaaataatagcacaagagggggaccacaccatcaattctgtttataaagtccatgcatctctatccttagtacacaatgagatactaggtagtctgattcaaaatttttctttgttccttgaaaaaatatttgagttattttttgtctgtatttaatgttgtgtagctgtgaactcttcacaataatgccatgggaacatattttcctcctggaactagtgcaccgccatcctatatcttgatgttttgcttattgatgttgatataatgtacatgatatccaaattttaacctttatttgactttttagaatgagttatagacttatagttgagtggatttggtcaagacacttgttttttttctctctcatgatgttgcaatagaccatatactttaagcatctgtggagaatacgacacgtaaaccagcatcgatattcgatattcttgtgtgggttttaagttcttatgcccaagtgcaatgttatgatctgttaatcaaaagactgaaacgagatagtactgactttccaaaacttgatcagaacaatattcctgtatactgcccagcattgactgatggatcgcttggagacatgctattctgtcatgcagtccgcaatcctggcctaattattgacattgtacaaggcaagtttgtgtgcttggttttcttgcttttgcattcaattttttttctcatattatgctcgaaaatgtggcagatataagattgatgaatggggaagccattcatgcaaccccaaggaagacagggatcatagttcttggtggaggtctacccaagcatcatatatgcaacgccaatatgtttcgcaatggtgcagattatgcagtctatatcaacacagcccaagagtttgatggcagtgattctggagcacaacctgatgaagcagtttcatggggaaagattaaaggttcagccaaacccgtcaaggtatatttctgtaccttgagcaattttcacatgattatttttaatatttgatgtgcgcctagctagctaaaagtgccttttgttaaacatcatatgctgcatatatgaacatttttgtcagcttcgcttgaacaaggtatgccaaagagattgcatcaatgatcttggactagatcctaattctaatccatcttatattcatttcacagttttgctctgtattgcacctatatcttttgatgcattttagctttgaagcatgcatcaattttactttgttcaatgatttatgcgatgatggttgacatgattctgctttgcctgatatagaagatctgaacgagaaattatgataccaagagatagttggagcatcgttaactcatacaccatggatgtttgtcgcactataaacctataatcttgatacctcaagtcctcaaccttttgaaatgcaggtgcattgtgacgctacgatcgctttcccattaattgtggctgcaacattcgcacgcaagtttcacggtgcgaaacaagcgaactgaatttctgggtttgagctaaaccgattcctgtcgaattcgtctccccaagttgagtgttcagacctcggagcacggcttgtacatcccttctcagggatggagcaggaaggttttgttggtagtaaaatggtacttactcacgaactgtacggccatgcttgatcatctttcttcattgtgcacattcgatcatctttcttcgtggtacaccactgaggctgtagtagcattttgcttgcgtgttgcaggggacacttcatggaagttaagacattgttcgctttgttcatccgctgttcggatgatttctgactagtgcaagagggaaaaggatatttatctcacagaccgttttggatatgtacgcattcagcgagaacaaatgggtatatgtaatttgaattccgtatcaattgttttgctaggaaacaggaaaggagggaaaatgaaaaacaggagtccaagcagattttcttcggtaca

SEQ ID NO: 333 - DNA, 523 bp, Oryza sativa Japonica
  misc_feature: exon 1
tggcggcgccgccggccgcccccacctcaccttccgccgcctttgcctcccgctttctccaagcgcggcagcgccgccgccgccgccgccccgtctttctccttgccctccggctcgctctgctgggtcgacgaaaagcccggcccatctgcatcgttgaaagcaacacctccacccaaactacagccgcgcggaatctgattcttttttttttctcggaaaaaaaaaatcaattcgaagctcacagtagctcgcggcggcggcggcggcggctcgggctccgacttcgtgggcgatggcgggggcaggaggagggggagtgcgcgacatggacgcgctggagggcgtgcgctcaatcgtgttgaagccctcggagtccctcgacgaggggcggttcacgaggatcgccggcgccgacttcaacgacgccggcctcggcctccccgggctgctcgcgtcgctcgccaccaccggattccaggcctccaacctcggcgacgccgtcgacgtcgtcaaccagatg

SEQ ID NO: 334 - DNA, 595 bp, Oryza sativa Japonica
  misc_feature: intron 1
gtacgttactaattactgcaccctttgcagccttcctgccttttgcatgcccgtgagggaggcgaagcggatttgggggttactgtagcttgaaattgttgtgtttctagatccttggagtttcttaggaattgcaatttagacgaggcccattgctgtagctgtgttggtgtaattggagctgaagaggtgaagtcatgtgctgaatgatgcgatagatgtggttgctataaaatcggaaacttgcagcttattattcatgctagggttgacactctactgatgattatctcgataattcctgtcagatgaaacagttagcaaatttgaaatggtgtaggtgtataaaaaatgctaccaaatttacttatttacattgtgaatttattggacaactccaaatgtacacttgaacttcctcgtaagtgatctggaggtaatccagatgaaaaattatgaaaaaaaactctctgttaccatcttacatgtgtgttccacgattttccactttaacatttccatgatattttttaacacctttaagatgttctgatactccctaaccctttctattctgttcttgaatgcactgaag

SEQ ID NO: 335 - DNA, 168 bp, Oryza sativa Japonica
  misc_feature: exon 2
ttagattggaggctgtctcacgagaagccacgtgaggactgtgatgaagctgagcttgatcctacatatagagaatctgtaaagtgcaaaatattcctgggattcacttcaaaccttgtctcttctggcattcgagatgtagtccgttttctagttcagcatcacatg

SEQ ID NO: 336 - DNA, 149 bp, Oryza sativa Japonica
  misc_feature: intron 2
gtgagaatcgcgttgctgtaatttccttttatgacctggtttggtagagatggttttacatgcttttggtaacatactagcattatcaaaagcattgatatcttatccctatgatgtagctaatcccccttgaaaaatgtgttatttag

SEQ ID NO: 337 - DNA, 219 bp, Oryza sativa Japonica
  misc_feature: exon 3
gtggatgttattgttacaactgctggtggtatagaggaggatctcatcaaatgtcttgctcccacttatagaggagaattttctttacctggaacactgttgcggtcaaagggattgaatcggattggaaatcttttggttcccaatgataactattgcaagtttgagaactggatcatgccactttttgatcagatgctacaagagcaatccactgag

SEQ ID NO: 338 - DNA, 570 bp, Oryza sativa Japonica
  misc_feature: intron 3
gtactgttacatttttcttctggctgaagcgcagataacttgcagcaatgtgttcaacactatataatgcacatgtgcttatgattcattagctgtatagaggaggaatcatgtattgggcagtaatataaaatgacctagcttagagtgcttagaactccactagtattatggtacagaatgttcaaaaataagaaacatgagagaaaaaacttaaatggaaagcagctataatctgccccacaagtactcccaaataataaattaaaatatgttgaatttcaatgctacaggaataaaaaggatctatgcacattatttgaaccagccttcattagctccctttcaaattggtccgtgttttattaacctagtaatgatacacgcacaaatccaaataaaactgacatatgaggacaccaactatgaatttctgtagctttactgctgtgcccttgttttccaactatcaattatcagatacatcttttctctcagaagcaactcttccaactacttttgtgctctctctcctgttcatgaagtacgatcaattttacttacctgcag

SEQ ID NO: 339 - DNA, 84 bp, Oryza sativa Japonica
  misc_feature: exon 4
aatgtttggacaccatcgaaggtcatagcttgtcttggcaaagaaataaatgatgaaagttcctacctttattgggcgtataag

SEQ ID NO: 340 - DNA, 592 bp, Oryza sativa Japonica
  misc_feature: intron 4
gtaacacatgtttattaactacacctgaatatccttacaaagtgcaaaataatagcacaagagggggaccacaccatcaattctgtttataaagtccatgcatctctatccttagtacacaatgagatactaggtagtctgattcaaaatttttctttgttccttgaaaaaatatttgagttattttttgtctgtatttaatgttgtgtagctgtgaactcttcacaataatgccatgggaacatattttcctcctggaactagtgcaccgccatcctatatcttgatgttttgcttattgatgttgatataatgtacatgatatccaaattttaacctttatttgactttttagaatgagttatagacttatagttgagtggatttggtcaagacacttgttttttttctctctcatgatgttgcaatagaccatatactttaagcatctgtggagaatacgacacgtaaaccagcatcgatattcgatattcttgtgtgggttttaagttcttatgcccaagtgcaatgttatgatctgttaatcaaaagactgaaacgagatagtactgactttccaaaacttgatcag

SEQ ID NO: 341 - DNA, 106 bp, Oryza sativa Japonica
  misc_feature: exon 5
aacaatattcctgtatactgcccagcattgactgatggatcgcttggagacatgctattctgtcatgcagtccgcaatcctggcctaattattgacattgtacaag

SEQ ID NO: 342 - DNA, 74 bp, Oryza sativa Japonica
  misc_feature: intron 5
gcaagtttgtgtgcttggttttcttgcttttgcattcaattttttttctcatattatgctcgaaaatgtggcag

SEQ ID NO: 343 - DNA, 236 bp, Oryza sativa Japonica
  misc_feature: exon 6
atataagattgatgaatggggaagccattcatgcaaccccaaggaagacagggatcatagttcttggtggaggtctacccaagcatcatatatgcaacgccaatatgtttcgcaatggtgcagattatgcagtctatatcaacacagcccaagagtttgatggcagtgattctggagcacaacctgatgaagcagtttcatggggaaagattaaaggttcagccaaacccgtcaag

SEQ ID NO: 344 - DNA, 458 bp, Oryza sativa Japonica
  misc_feature: intron 6
gtatatttctgtaccttgagcaattttcacatgattatttttaatatttgatgtgcgcctagctagctaaaagtgccttttgttaaacatcatatgctgcatatatgaacatttttgtcagcttcgcttgaacaaggtatgccaaagagattgcatcaatgatcttggactagatcctaattctaatccatcttatattcatttcacagttttgctctgtattgcacctatatcttttgatgcattttagctttgaagcatgcatcaattttactttgttcaatgatttatgcgatgatggttgacatgattctgctttgcctgatatagaagatctgaacgagaaattatgataccaagagatagttggagcatcgttaactcatacaccatggatgtttgtcgcactataaacctataatcttgatacctcaagtcctcaaccttttgaaatgcag

SEQ ID NO: 345 - DNA, 570 bp, Oryza sativa Japonica
  misc_feature: exon 7
gtgcattgtgacgctacgatcgctttcccattaattgtggctgcaacattcgcacgcaagtttcacggtgcgaaacaagcgaactgaatttctgggtttgagctaaaccgattcctgtcgaattcgtctccccaagttgagtgttcagacctcggagcacggcttgtacatcccttctcagggatggagcaggaaggttttgttggtagtaaaatggtacttactcacgaactgtacggccatgcttgatcatctttcttcattgtgcacattcgatcatctttcttcgtggtacaccactgaggctgtagtagcattttgcttgcgtgttgcaggggacacttcatggaagttaagacattgttcgctttgttcatccgctgttcggatgatttctgactagtgcaagagggaaaaggatatttatctcacagaccgttttggatatgtacgcattcagcgagaacaaatgggtatatgtaatttgaattccgtatcaattgttttgctaggaaacaggaaaggagggaaaatgaaaaacaggagtccaagcagattttcttcggtaca

SEQ ID NO: 346 - DNA, 3316 bp, Populus deltoides
ggaggaagatttgctatcatcagtacggaccacagtgtttaaagaatcagaagctcttgatgggaaatgcattaaaattgaaggttatgattttaatcaaggagtgaactactctaagcttctcaaatccatggtctctaccgggtttcaagcttccaaccttggagatgccattcaagttgttaataacatggttagtaagttaatctcgtttctttaaaaccctagaatttttttcttttgggctctttttttttggtgtttttggatgattctatgtctttttgtgtttgattttgatacccaattagttgatttaatgagtttttttttttggaatgaagctagactggaggcttgctgatgaagagataacagaagattgtagtgatgaggagagggagttggcctatagagagtctgtgagatgcaaactgttcttgggttttacatcaaatcttgtttcttcaggtgtcagagatacaattcgatatcttgttcagcatcatatggtgagttaatttcatggtttgatattgattgatatattcgctgtcttgtgtttgatggaatggcttgacgatgtttatgtggaaactgtgccaacataaatacaaagcagaatcaaatggttattgacaattttgggttggcattgaaatctcccctttaattgcatatgctggatgccctgtaacaaaaaatattgcctattggttttctccttgttggttgtattgaaaatcgttaaactttagagctgttcgcatcagatgtttgcattattctaactatttgggcttgttttatgagaaagtatatatagaggtcaggtacttgtgaaacctatgatcatcttaatgtcatttataaaaaatttaaggtttctgaatcaatgtgttgcatcaattcgccgttgtttggctgtaacctgtaaataattttaagctgtccaccctcttgattgtattcttgcctttcatctcaaattggtttatgcatgccttatttgtaagatgactgcaggttgatgtagtggttacaacggcaggtggcatagaagaagatcttataaaatgcctggcaccaacatacaaaggtgacttttctctacccggggctcaattacgatcaaaagggttgaatcgaattggtaacttgttggtacctaatgacaactactgcaaatttgaggattggatcattccaatctttgaccaaatgttgaaggaacaaattgaagaggtatttctctcatagtcacaacaactatgtttctgtgcgtgagtttgaggaatgtttgctgagttttttttttccttttccccatccattattttctctgacaaacatgctgtcaaaagcggtacttttagatattttaactgatctgacatgctgacataccaacaaataaaagccacatctgcactatattagcagatatctaaatctgaactgatttggttggttttaaagagtcgagacacaaaatttagaaaaaagttagtggcagtacttgattcatcaattgctttttttccctcctggtaaaattgattgctaaaatctaaatatactaatttaggatttactcgtttgatttactttagaagaaagctccatcatccttatcacatcttcttttgggcattgcagaatatcacctggacaccttctaaattaatagctcgcatggggaaagaaataaataatgagagttcatacctttattgggcatataaggtaagtgatttatccgctctcagctgacatggttcatttatatgagaattattttcgtgagatttattcaaactattatcacctatttggttgtttcatctgctatttttgttttttcattctacttcgacaatgattgtgttatgtgcatttgttacacgtgccacattgatgccaaatatatgtttgctgtggatttagttctagttttcacatagtagatggtacattgttatgtgtcccccctatttgtaatgatagtcaaatttgtggctcttttgtgaatctttgttaaataacaataaaatatcacaactcttagattttgatctgtcaatcaaaccaattgctcctttgcaacgtgggatgaggtgataaagacatgacaattacactatgtattaaggaacactggaaaatctgatatgttattcttttcgatgttattaattctatgagaacaatggcattaacatttttgtgagttttgtgagttgatgttgctttttatgtttttcagaacgacattccagtattctgtccaggcttaacagatggttctctaggggacatgctatactttcattccttccacaaccctggtctaattgttgacatagttcaaggttcctgtttgcttctgcaatgctatttttttcatgataaatataatctgagatgcaaaccctataatagatattttttgaacagatattagagccatgaatggtgaagctgtccacgcaagtcctagaaaaactggtatcatcattcttggaggtgggcttcctaagcatcatatatgcaatgccaatatgatgcgtaacggtgcagattatgctgtattcatcaatacagcacaagaatttgatgggagtgattctggagctcatcctgatgaggctgtatcgtgggggaaaatacgaggttctgctaaaactgttaaggtatggattactttctcttcattcctcctttgcttaaaccctgtcaggttttgttatcaatgccacttgcagatctcacaattagctacgagcatcatacttctgtgctttatttcctttcgtgtatgagttgtgagattccattgcagtttcctcttctaatgatattctgttttcggtgcaataatcattcttcttccgtcttgttggatttaaccaggtccactgtgatgcaactattgcttttcctctcctagttgctgaaacatttgcccctaggaggaacagattctgcagcagtactcaaagctagggctgtgtgcagttcttggccagaaaattgattcatttttatttgtattatgactgaacgatccgcaggatgggtagtgggctccattgatgccataaacttctttttttttcccctcagaattaagggatccgccagaacacactgctctcagccccaaaccattgttgcctctactgggagtagcataaccaattgaattgcgctcctccaagcagcgcctcttagttgcgttatttattgtaagtagcgcaaccaactaaattatgctagttcccacatttattgactgctattttcaaaagaaaaa

SEQ ID NO: 347 - DNA, 193 bp, Populus deltoides
  misc_feature: exon 1
ggaggaagatttgctatcatcagtacggaccacagtgtttaaagaatcagaagctcttgatgggaaatgcattaaaattgaaggttatgattttaatcaaggagtgaactactctaagcttctcaaatccatggtctctaccgggtttcaagcttccaaccttggagatgccattcaagttgttaataacatg

SEQ ID NO: 348 - DNA, 151 bp, Populus deltoides
  misc_feature: intron 1
gttagtaagttaatctcgtttctttaaaaccctagaatttttttcttttgggctctttttttttggtgtttttggatgattctatgtctttttgtgtttgattttgatacccaattagttgatttaatgagtttttttttttggaatgaag

SEQ ID NO: 349 - DNA, 168 bp, Populus deltoides
  misc_feature: exon 2
ctagactggaggcttgctgatgaagagataacagaagattgtagtgatgaggagagggagttggcctatagagagtctgtgagatgcaaactgttcttgggttttacatcaaatcttgtttcttcaggtgtcagagatacaattcgatatcttgttcagcatcatatg

SEQ ID NO: 350 - DNA, 514 bp, Populus deltoides
  misc_feature: intron 2
gtgagttaatttcatggtttgatattgattgatatattcgctgtcttgtgtttgatggaatggcttgacgatgtttatgtggaaactgtgccaacataaatacaaagcagaatcaaatggttattgacaattttgggttggcattgaaatctcccctttaattgcatatgctggatgccctgtaacaaaaaatattgcctattggttttctccttgttggttgtattgaaaatcgttaaactttagagctgttcgcatcagatgtttgcattattctaactatttgggcttgttttatgagaaagtatatatagaggtcaggtacttgtgaaacctatgatcatcttaatgtcatttataaaaaatttaaggtttctgaatcaatgtgttgcatcaattcgccgttgtttggctgtaacctgtaaataattttaagctgtccaccctcttgattgtattcttgcctttcatctcaaattggtttatgcatgccttatttgtaagatgactgcag

SEQ ID NO: 351 - DNA, 219 bp, Populus deltoides
  misc_feature: exon 3
gttgatgtagtggttacaacggcaggtggcatagaagaagatcttataaaatgcctggcaccaacatacaaaggtgacttttctctacccggggctcaattacgatcaaaagggttgaatcgaattggtaacttgttggtacctaatgacaactactgcaaatttgaggattggatcattccaatctttgaccaaatgttgaaggaacaaattgaagag

SEQ ID NO: 352 - DNA, 414 bp, Populus deltoides
  misc_feature: intron 3
gtatttctctcatagtcacaacaactatgtttctgtgcgtgagtttgaggaatgtttgctgagttttttttttccttttccccatccattattttctctgacaaacatgctgtcaaaagcggtacttttagatattttaactgatctgacatgctgacataccaacaaataaaagccacatctgcactatattagcagatatctaaatctgaactgatttggttggttttaaagagtcgagacacaaaatttagaaaaaagttagtggcagtacttgattcatcaattgctttttttccctcctggtaaaattgattgctaaaatctaaatatactaatttaggatttactcgtttgatttactttagaagaaagctccatcatccttatcacatcttcttttgggcattgcag

SEQ ID NO: 353 - DNA, 87 bp, Populus deltoides
  misc_feature: exon 4
aatatcacctggacaccttctaaattaatagctcgcatggggaaagaaataaataatgagagttcatacctttattgggcatataag

SEQ ID NO: 354 - DNA, 520 bp, Populus deltoides
  misc_feature: intron 4
gtaagtgatttatccgctctcagctgacatggttcatttatatgagaattattttcgtgagatttattcaaactattatcacctatttggttgtttcatctgctatttttgttttttcattctacttcgacaatgattgtgttatgtgcatttgttacacgtgccacattgatgccaaatatatgtttgctgtggatttagttctagttttcacatagtagatggtacattgttatgtgtcccccctatttgtaatgatagtcaaatttgtggctcttttgtgaatctttgttaaataacaataaaatatcacaactcttagattttgatctgtcaatcaaaccaattgctcctttgcaacgtgggatgaggtgataaagacatgacaattacactatgtattaaggaacactggaaaatctgatatgttattcttttcgatgttattaattctatgagaacaatggcattaacatttttgtgagttttgtgagttgatgttgctttttatgtttttcag

SEQ ID NO: 355 - DNA, 106 bp, Populus deltoides
  misc_feature: exon 5
aacgacattccagtattctgtccaggcttaacagatggttctctaggggacatgctatactttcattccttccacaaccctggtctaattgttgacatagttcaag

SEQ ID NO: 356 - DNA, 85 bp, Populus deltoides
  misc_feature: intron 5
gttcctgtttgcttctgcaatgctatttttttcatgataaatataatctgagatgcaaaccctataatagatattttttgaacag

SEQ ID NO: 357 - DNA, 236 bp, Populus deltoides
  misc_feature: exon 6
atattagagccatgaatggtgaagctgtccacgcaagtcctagaaaaactggtatcatcattcttggaggtgggcttcctaagcatcatatatgcaatgccaatatgatgcgtaacggtgcagattatgctgtattcatcaatacagcacaagaatttgatgggagtgattctggagctcatcctgatgaggctgtatcgtgggggaaaatacgaggttctgctaaaactgttaag

SEQ ID NO: 358 - DNA, 220 bp, Populus deltoides
  misc_feature: intron 6
gtatggattactttctcttcattcctcctttgcttaaaccctgtcaggttttgttatcaatgccacttgcagatctcacaattagctacgagcatcatacttctgtgctttatttcctttcgtgtatgagttgtgagattccattgcagtttcctcttctaatgatattctgttttcggtgcaataatcattcttcttccgtcttgttggatttaaccag

SEQ ID NO: 359 - DNA, 403 bp, Populus deltoides
  misc_feature: exon 7
gtccactgtgatgcaactattgcttttcctctcctagttgctgaaacatttgcccctaggaggaacagattctgcagcagtactcaaagctagggctgtgtgcagttcttggccagaaaattgattcatttttatttgtattatgactgaacgatccgcaggatgggtagtgggctccattgatgccataaacttctttttttttcccctcagaattaagggatccgccagaacacactgctctcagccccaaaccattgttgcctctactgggagtagcataaccaattgaattgcgctcctccaagcagcgcctcttagttgcgttatttattgtaagtagcgcaaccaactaaattatgctagttcccacatttattgactgctattttcaaaagaaaaa

SEQ ID NO: 360 - DNA, 12281 bp, Phalaenopsis equestris
cctctcaataatctgcatgtaatgagtttcgcgctttcgtagatccacttgttagagataagtgagctctgaataacctggcacttacgcagcgctgcttacgtgcgcaaatattttcccgtcgggggcgggatctctcttccgaattccgtttgtattggcttgcgctgctctccgagactaggtttaacgccaaggagtggtattcggcgaagcagtagggtaatggccggcgccgctggcgaaggtcagcgggaaaacctcgaagctattcgttccgtcgtctttaaggaatctgaaaccttggacgaggtgagatttcagaagatctctggctatgatttcaaccgcggcgttgatttcagagggcttctggattccatggtctccactggtttccaggcatcaaacctaggagacgccgtcgagatcgtcaatcagatggtgcgttttcttacttttgtctgctattcgaatttctcagatgttttccgttctgtcagggactttgtagaaactagactgatgtctttgtttgatttcactacttttagtgtgtgtgcgggggtgtgtgtgtgtgtgtgttttttttttttccgtgcaatcgagtttttggaataaaatgatttttaatatgtctattttatcgttgaagttgttttaatgtaattttttatgttcaatcatactgaagttagattggaggctttcccatgagaaaccaacagaagattgcgccgaagaagagttggatccttcgttcagggaatccgtcaaatgcaaaatttttctgggctttacttcgaatctagtatcatcaggtgttcgggatatcatccggtttcttgtggagcatagaatggttagtaccatgaaagcaactacttctgcatgcactagtaaccatccttgattttttttttttttttctggcatttattgtcaatgcattttgattttatcctttataatgcagagctgctgacctcataggtttgttaaatatctaattcaatttgattttcttctacatatcaatgctacttcaatggacattatttaatgtttaataatttcatcatcatgattctttgaagtatattaactacaaaaaaataaaagcaatgcatttttttttaattttttaataggacttatctgatattttgctgatttggttgccgatcatctagtttctccttctgctagctgctcttgcaactcctccttctctccagggcttcagagcttcggcacagctccttgtgtcgcagatagggttattatactgtaacatttttagcttttatattgaggcaatttttatattgaggcaatcgtatgccaaatatctattgtaccctttgctgtatattacaagtttgccacttgtaatgtttataaatagctttacctgtaaccgagtttgatataataaaagcttacttttgtatttcattttccttctctattctcttctctctgttatttcatggtatcagagctgttagcctcacaacagctacaatatccatggattcaacatcctcaaccactcctcatctcattcaacaatctcaaggacctcttcacaggatgcaagaaactcacatttctgcaccgtttaaattcttgatacagcacataaaaaacgtgacaaatgctcctctggctttaaaaaattatgttgtttggaaggtacagattttgaaacttttctttgcgtatgagtttgattcttttcttgatttcaaaaaaaccccacagaaacccaaacagaaaatccagattatgccctctggagattagttgatcaaaattcggctgcagctatcttttcaaccatttcaccctcttttttacccaatgtatttcacttgaacaacacaacagatatttggattatcttagaaagtagattctaatcagccaatcgttcacggtttatctatctaaaaaatgaacgtcacaatattaacatggggacttagaccattgttcaatatcttacaagcataaaaaatattgtagacaacacaattgacgttgcatctaaggtagacaatgaagatattatcctatataccttaaatggcctatccccccaattaccaaggttttaaacaactattaaaactcagttacttcatagtgaggaaagtaatcttgtcaatggaattttaaaatccacccaaagaacaacccttctcaactataaaaccaaaaactctttcttgaaatcatgattttcttccatgaatccacaaaacaacaaacccatttctcacaatagctcccaatccaacaaccaatcattttatgtcagatatgtcacaagaaaggacattcagtgactcaatgttggcagatgactaacttacaatataaacatctcccaacagttcaacgactgctctcaatgccaccgtaagctcaaagaatcaagaccaggctctcgatacaagtgctacatcacatctaactccatatctcgacaacatccaacaacctactccctataatggatcagatcaagtaattgtaggtaatggacaaccaaccgaaattttccacattgtaaatggtctccttcctactctggattgtaagcttactctttcctctatactcagagttccaaatatttctcacaatgtaatttcagttttaaacatgctcaagacaataacagttctatcacttttcatgctaaggagtttattataaaggtcatagcacaaagaaacttcttcccaatagtcaacttaataaaagattatatccctttacagtgcttatagccaccatccatcctatgacttggcataaattggttaggtcatccacaccccaaagtcattcatcacattgctaaacaacatccccacttacaaatacacacactttaacttgtcaaaaatgttatcaaaataaaaagccataaacagccttttactgtcagcactaataaattttctttgttgcaaattatatgttatctttatagatgcttattctcgtttttgctagtattttcctttatattctatatttgaattgtcacttttttttattaccttgcataaacaattgaaaattaaacattacaaaaattttaaatattcaagatctgatggtggtgttgaatataaatttactcaacttcagacttatttgcaaaacagtgatatccatcatcaatttagccgcccttatctcccacaaaaaaatgaggtagcagaacaaaaaaattagacatattatagaaacgttagaactctttttaacacaactttcttattactaaaattttggatgacagctatgcatacaataatttgtcacattaatcatctgtcttctcataacacttacaacaaatcaccattccagcttttattcaaagcacctgaatatcaaaacctgaaaactttcagttgtgcctatttcccataacaaccacattttatgcatcataaatttactccgaaggttcctctctgtatgtttttgggctacagtcaacataaaaaaggctaccagtgttatgttgttcatcaagattgcatcattatttcacgccattttacttttaatgaactttctttcctcttaaagaaacccaaccacttgtgacccatacaccagctttttttctttactcccccgtctcttctaatacccatctcaactatcaattcttcaactcccaccccctccctcaacctctcaacaacagcacttcagaacccattcccctactatcttctcctcctcacaccagtctttcgattgacccctcatctgcacctcataacactaccaatgctacatcatatatctctattaccaattcctctcctatatctttttcactccctcccatcaacacccaccatatgactacaattacacaaacaagcaaaataaaaccttaaaaaaattttccactttctcatcacacttcctccgacaaacccattacctttaaacaagccatccaacattcccattggagaaaggcagcgtcagacaaatttataacacccttcaacagcaatggatatcgactcatgtaccacatcccctcaacaaaatgttttaggctgcaaatggacctttcgaatcatgcactataccgatagatctattgctcattacaaagccaggttggtagcccaagcttcaaacttcaacaagtactgaatttcaggaaacttttagctctattgtcaaattctctactattcacatgcttattgctttagccactaatgaacactgagatattaagcaatttgatgtttccaatacctttttacatgtcaaagtaaatattaatatatatgtcttaaccttctgattttacagattataaattatccgtaatatgtatgtaagttaactaaaacaatatatggcctcaaacaagtatcgaggcgatgatattcaatatttgtaactatttatatactcaaaagtttaaactcagcacttttgatcattccttgctcatatatcatcataacaatagtagtgtttatttacttctatatgttgatgacattcttatcgctgaaaattcaccgattgaaattaatcgcttaatacacatattattcaaacaatttaatgtaaaacagtttggttgtctctctcattttttcggtttgcaaattaataaaactgctactggctattttttacatcaaaccaactattaatctgatcttttaacaaaagccggtatgatgcaatccaaatctgttttaatgcctttaccacttctgctacacaaaaaccatattcattcttcacctctttccaatctacaacattataaacatctcattggtgccttacaataccttactgttactcgaccaaatataacttttagtgttaattttctaaatcagtatatgcatgattggactacccttcattttcaatttctcaaaagagtattaaggtattttaaaggcacttccaatcatggtctggcaatgacggctggaacgctttccctatatccttatgcaaatgcagattgggcaagtgatagcaatgatagaaaatcaacaacatgtttttgtacgtacctcggtcccaatttaatttcatggtcagcaaagagacaaaccactgttgcatgatcatctaaagaagctgaatattgtgctcttgacaccaccaccacagagattctatggctacaacgattacttcaagaacttacaaccataatcctgtttttcacgcaataacaaaatacattgaggtggattatcattttatcagatatcacatcaaactaaagcacatagtttttcaacacattatgactgaagatcagccaacaaatatcctcactaaagctctgacaaccaaaagacatcacgatcttgcaagcaagttgaccattcaacctctcgatgctcaacttgaagggggggtaataggacttatttgatgttttgctgatttggttgccgatcttctagttgctcatgctagctgcttttggttctcctctccagggctccagagcttcagcacagctccttgtgtcgcagatctcagctagggttattatcctgtaacacttttagctttttttattaaggaaattgtattccaaatgtctattgtgctcttttgctgtaaattacaagtttgctacttgtaatgtttctaaatagctttacctgtaacaaagtttgatataataaaaacttactttagtatttcattttccttctcttttttcttctctctgttatttcattttgactctatgaagtatattaactccataaaaatgaaagaatgcattttttttttcatttttgttagttttactcatttttaaatgtaaactggtttgaatgacattttcaggtggatgttgtggttacaactgctggtggcatagaagaagaccttataaagtgtcttgcaccgacatatagaggtgatttttctttacctggggcgtatcttcgctctaaaggattgaatagaattgggaacctgttggttcctaatgataattactgcagatttgagaattggatcactccaattcttgaccaaatgctagaagaacaatcaatgaaggtacttttagcagtgttatttttaaaattctaatattaacagatggatgtggtaaaccaagaatgataaaatgtgtaataattatgccagagagcttgtggaattagcacttcttcaagacaatttcaattaataaaagttggcttagatgatttgaacatgtgcattagggaggaaaacatgcttttatatgattaattgatagtgttaatgcattgcaaaagaagtactagttcaaagatattttggctagaagttgtaaaaaatgtactgatgtaatcttcaattgatatttcatgcaaaactcaattgaaatgaagggagtagctcgtcatgcctatatcaaatagtctgtatgaatccgttgtttctctggttgcagttgctgatgatcattaatagttgaatagaaattggtttatattctgtcttaatatttttttgttgtgatgttctaggaaatactaaatgaattctattgcttttttgctgatattttttattcatttattcaagtttagttttcccatcatgttagtatttcttgagtggttttgcaaaattatatatgcaatgatttgctaatctagtgaccgttcagtcatttgtggttttcaaagtttagaacacatatgggagagatcggtaagctattggcatgcattaacaaggtgttatgaagtggaccattatgaacatttagtcatatcctgtctatttgtgatcagctttatatatatatatatatatatatatatataatgttacatgctattaaccgtttgaatattgttcggctcacttaatctgatggttgaatatattttctccaatgttcaaggcctagcacatgtgggggtatgtgtgagtttaaaacagaaaaaacatttgcatttatatcacataattattatccgtttacatatccaacacccaaactttcatatattcatgcataacactcaaatatctaaaattacataaaaaataccactacaactgacgtttaaatagtgaaattcactttttcatgcaaaaattatgacattagtgttataaatttaaatatctaactttaggtgttatatatgtaaatacatatgaattgtgcgatgtgtaagaaaaattttcaaaataaaaataacgaaaatcctgtgtgaaggtttttttttggcataatttttaagtatgttatttttattctatccctttttacatcctttaaatttctcaaaaatgtccatacaaaatccattttgtagagggtacagcttgcggcgaggtgtgaaatggatgctatttatattgaaatgtacttacatgaaggacacatgtacttatagaattgttccttttaaatgtttgttctattgcaaagctagcttattttcaactcttttagctagccctctttttttaactttttggcacagattaattcacccacacgatctccatggttacattgctgtctctgtttatgtcatgcttgatgaattatttattatgcagaattctttaatatgatcagaatatatatttgcaattttggttggctaaaagtctgtgtctaggcataaagcattttctcattattaacacaacatcatggtgtatcgttggagttcataagtgatatgtttttacttttcttttttttttttctaaagagacgtttgacttcttgacttagaaaatcgctttaatattatttttttgcagtttatattttacattatgatatattatgtttgacataattatggagaataggtgctttccagtatttaatttggtttccgggaaactttgtctgtgtgaaaaagtgtaattccaagaaaatatttctgattttttgtttcctacttttttgttaaatggccacagccacttaatttctcttcattctttccgcactatatatacatgacaattttcacttacaatccattattttaagatcaagtcatgttgcctctagttatccgcctacatctagttttttatttgcatcacatcttctattgcttgatgccacaggatgtgaattggacaccttcaaaagtgatttcacgcttgggaaaagaaataaatgatgaaagttcgtacttgtattgggcatataaggtgattttattatcaaaattaatttctcagcttctttttttatggcagatgtctaaattatttctaagctgttggattatggcaatatattgcttgatgtttgattttatggaaaattatttcgatttcaggttacttttgcagagcactatgcttttcatgattctgagacgtgattattcaaccgtacaaaaaaaggtttttatgaatgaatagctttgaagaataaaaatagaagtgatgatttcctcagaacaggcggtggagcgaaagatgtgatttagctgttaatatttcatgataatttgctaaaaatgcaaactgaaagtttgaagctgactgggcttgaagtggggtaaaatactagctgcattaagaagatttcatacgagttttaggggagtttagaagttgatcaaacttaaaaaattctcgtagtcaagtgaagagctacaaaaaactattgaaaatagaaaattgggcaagtttttaagcaagaaagaaatgcgatgcaaaaaaatgacttgagcggtagaacaaatatcttgggactttgatcaacgtggtgaattaagaattaagcttgtagggtgcactaggctaactaagttgaagatcttcatagaaaaacaaactgaaagttttgaagttgactaggcctaaagtggggtaaaatactagttgcattaagaacattttcatatgaggtttgggggagtttcagaattgatcaaacttaaaagatgctcgttgtcaaatgaagagccacaaaaggttattgaataatagaaaattgggcaagtttcctagcatgaaagaattgatatgggaaaaataacttgagcaatagaataaatatcttgggactttgatcaatgcggtgaattaagagttaaggtagcagggtgcactagtctaactaagttgaagatcttcatgaaaggtaaaattgattgagaaattattaaatgatacactttacagaagaaattttctaaatgagaaaaatgaattagattttgaaggatgctgttggttaaaaaaatagtggtcttgaattggtgctgaagatgcataaagttaagattttaggcctaaatgagattcctatcgagatttggtagatatttgacaatataagtaacatacttttgaaattaagggaatgcttattgagcaagagcagttatggtaggcttattatggttcgtaaaatgaactatagagatgtttactattatgacgtatgggttatacggtgcagttgtgggaggctaattgaacaaagtttgtaaaatcgatttagtatcaagaagaaatttagttttatgccaagacttattatagatgtgttatttgtgtaatttaattaatggtgaaatttaaaaataaatgaacattgaaatagttttaatattatattgtttgatattgagaaggaatatggtcgagttgaacttgttgggcattaagattaaaggatgtgtgtgaaaggtttgtcatagttaggcaaacatatatgatgaagtagcatttaacaatagaaataattatggaacgttcaaaattcagtcatattaaggtaatatctatggtcaatgtcatcagtagccttacccaactatttgtggtttgctttatgaatccttaatttccattcacacaaatcatcttaaatgagttttatcagtgtaaccttagtttttatcctttttaatcatctgaaactaatattatttgcttgtctaatatgcatatttctgcctttagttacatacgtttaaatctctcaactctttgctaattattttcttcagtagctagctaatggcggtgggtgaattttttatgagattaactttcgaaaaagattatgaatcttaagtttaatgtttaagaaagtcttttttagttgaatgatgagtttggaggggtatattgttagaaatgctaagagtagtttatattgagttagttcaggttgatttagaagggttaatttgaggaatgagattttgatgagacaaatggctagaaatgtttattgtggatgagctcggaatgtgtagttgtgatatggtgtatggttaggttcgaagaattttaaataaatgttgatgagtagggaacgatatttggtcttactctcacctaatttggttgagagttacaggtggattttagagtagttgtgaggcttgggttgggtgttagacagatttggagaagttttaggatgcaaaggatgatgcttggttgatttggattaggtgtttaagggaggagagtagctaaattaaaataaaatgataactatctttagctcacaaaattaaagaaaattgtacaattcaagccatcacgttgcttgggttgatacaacttccatatagattttgacaatgttcttgggtctactacaacttactaataaatccactcaaccgtgttgcttgggttgatacaacaaatgattaactcgttgataattaataattggatataataaaattgtccctcaattaatcaataattttttaataatcaaaatagtgcccgactatttcatggggccgttttagtgtcagagtttaatgaactgccaaaatagtctcctgactttttaaattggggttgaaatgattttcatggagaacaactagaactcaattttaaaatagtcagggactatgttgacacttctataaacttagttactaatacggccccatgtaaatagtcggaagattattttggcactttactcaataattaatattttttcaaaagttttggatcgtctacttttctctcaattatgttataagctagtgctagctgatatatatccttcaatttgagttggaatgtcagtgtaggaagactatcttcaatataggaagagtgatgagtggtatatatttatttatgtattctctataacattgtactcgtttttctattataaataaaaggcttacaaagaaatgacttcaattaacttttcagaatggaatacctgtcttctgccctggactaactgatggatctcttggagacatgttgtattgtcatgcgataagaagcggtggtttgaatgttgacattgttcaaggtccttaacactcattatttacgtaatttacaatatttgttagtcttgttccttgataatttgcttctccctcttccttcagatatacgatccatgaatagcgaagctgttcgagctggtcttaggaagactggaatgattattctaggcggcggacttccaaaacaccatatttgtaatgccaacatgatgcgtaacggttcagattatgctgttttcatcaacaccgcacaagagtttgatggcagtgattcaggagctcagcctgatgaggctgtttcatggggaaaaataagagcctctgcaaaaacggtcaaagtatgttttttatccttctcgttcgcacatttgatgcttattaatgatgttatatttacgtttgaactcatgctagtgcttcaaaaataaatttcaatgattgtgcattgggcatcttcttagacatgcacacttctggtaaattttgaagtaccaaatcaatccaaaaccaaaacaagatttaaataaaaactcatattatgttatgtttgtatcctcgaagtaattaacatcaacattctgttacatgttagtctgattttttttctaagtgttaagctaaaattctcaggtacactgcgatgcaaccattgctttccccctgcttgttgctgtaacatttgcaagaaggtttgaagatgcttctacttcggccgacattaaatccgactaaacccagtgagcttatccctcacctaagttaagatttcctcgttgtatttgtgctttctgtgactctggctaacattttgatcattagcggatagtttgagacagcttgtagggatcggttgttatgctgacaaaaaacaaaccatttaattaatatataattcaacatttttgaaatgttcctatttacaaaattaacattgccaat

SEQ ID NO: 361 - DNA, 444 bp, Phalaenopsis equestris
  misc_feature: exon 1
cctctcaataatctgcatgtaatgagtttcgcgctttcgtagatccacttgttagagataagtgagctctgaataacctggcacttacgcagcgctgcttacgtgcgcaaatattttcccgtcgggggcgggatctctcttccgaattccgtttgtattggcttgcgctgctctccgagactaggtttaacgccaaggagtggtattcggcgaagcagtagggtaatggccggcgccgctggcgaaggtcagcgggaaaacctcgaagctattcgttccgtcgtctttaaggaatctgaaaccttggacgaggtgagatttcagaagatctctggctatgatttcaaccgcggcgttgatttcagagggcttctggattccatggtctccactggtttccaggcatcaaacctaggagacgccgtcgagatcgtcaatcagatg

SEQ ID NO: 362 - DNA, 250 bp, Phalaenopsis equestris
  misc_feature: intron 1
gtgcgttttcttacttttgtctgctattcgaatttctcagatgttttccgttctgtcagggactttgtagaaactagactgatgtctttgtttgatttcactacttttagtgtgtgtgcgggggtgtgtgtgtgtgtgtgttttttttttttccgtgcaatcgagtttttggaataaaatgatttttaatatgtctattttatcgttgaagttgttttaatgtaattttttatgttcaatcatactgaag

SEQ ID NO: 363 - DNA, 168 bp, Phalaenopsis equestris
  misc_feature: exon 2
ttagattggaggctttcccatgagaaaccaacagaagattgcgccgaagaagagttggatccttcgttcagggaatccgtcaaatgcaaaatttttctgggctttacttcgaatctagtatcatcaggtgttcgggatatcatccggtttcttgtggagcatagaatg

SEQ ID NO: 364 - DNA, 5039 bp, Phalaenopsis equestris
  misc_feature: intron 2
gttagtaccatgaaagcaactacttctgcatgcactagtaaccatccttgattttttttttttttttctggcatttattgtcaatgcattttgattttatcctttataatgcagagctgctgacctcataggtttgttaaatatctaattcaatttgattttcttctacatatcaatgctacttcaatggacattatttaatgtttaataatttcatcatcatgattctttgaagtatattaactacaaaaaaataaaagcaatgcatttttttttaattttttaataggacttatctgatattttgctgatttggttgccgatcatctagtttctccttctgctagctgctcttgcaactcctccttctctccagggcttcagagcttcggcacagctccttgtgtcgcagatagggttattatactgtaacatttttagcttttatattgaggcaatttttatattgaggcaatcgtatgccaaatatctattgtaccctttgctgtatattacaagtttgccacttgtaatgtttataaatagctttacctgtaaccgagtttgatataataaaagcttacttttgtatttcattttccttctctattctcttctctctgttatttcatggtatcagagctgttagcctcacaacagctacaatatccatggattcaacatcctcaaccactcctcatctcattcaacaatctcaaggacctcttcacaggatgcaagaaactcacatttctgcaccgtttaaattcttgatacagcacataaaaaacgtgacaaatgctcctctggctttaaaaaattatgttgtttggaaggtacagattttgaaacttttctttgcgtatgagtttgattcttttcttgatttcaaaaaaaccccacagaaacccaaacagaaaatccagattatgccctctggagattagttgatcaaaattcggctgcagctatcttttcaaccatttcaccctcttttttacccaatgtatttcacttgaacaacacaacagatatttggattatcttagaaagtagattctaatcagccaatcgttcacggtttatctatctaaaaaatgaacgtcacaatattaacatggggacttagaccattgttcaatatcttacaagcataaaaaatattgtagacaacacaattgacgttgcatctaaggtagacaatgaagatattatcctatataccttaaatggcctatccccccaattaccaaggttttaaacaactattaaaactcagttacttcatagtgaggaaagtaatcttgtcaatggaattttaaaatccacccaaagaacaacccttctcaactataaaaccaaaaactctttcttgaaatcatgattttcttccatgaatccacaaaacaacaaacccatttctcacaatagctcccaatccaacaaccaatcattttatgtcagatatgtcacaagaaaggacattcagtgactcaatgttggcagatgactaacttacaatataaacatctcccaacagttcaacgactgctctcaatgccaccgtaagctcaaagaatcaagaccaggctctcgatacaagtgctacatcacatctaactccatatctcgacaacatccaacaacctactccctataatggatcagatcaagtaattgtaggtaatggacaaccaaccgaaattttccacattgtaaatggtctccttcctactctggattgtaagcttactctttcctctatactcagagttccaaatatttctcacaatgtaatttcagttttaaacatgctcaagacaataacagttctatcacttttcatgctaaggagtttattataaaggtcatagcacaaagaaacttcttcccaatagtcaacttaataaaagattatatccctttacagtgcttatagccaccatccatcctatgacttggcataaattggttaggtcatccacaccccaaagtcattcatcacattgctaaacaacatccccacttacaaatacacacactttaacttgtcaaaaatgttatcaaaataaaaagccataaacagccttttactgtcagcactaataaattttctttgttgcaaattatatgttatctttatagatgcttattctcgtttttgctagtattttcctttatattctatatttgaattgtcacttttttttattaccttgcataaacaattgaaaattaaacattacaaaaattttaaatattcaagatctgatggtggtgttgaatataaatttactcaacttcagacttatttgcaaaacagtgatatccatcatcaatttagccgcccttatctcccacaaaaaaatgaggtagcagaacaaaaaaattagacatattatagaaacgttagaactctttttaacacaactttcttattactaaaattttggatgacagctatgcatacaataatttgtcacattaatcatctgtcttctcataacacttacaacaaatcaccattccagcttttattcaaagcacctgaatatcaaaacctgaaaactttcagttgtgcctatttcccataacaaccacattttatgcatcataaatttactccgaaggttcctctctgtatgtttttgggctacagtcaacataaaaaaggctaccagtgttatgttgttcatcaagattgcatcattatttcacgccattttacttttaatgaactttctttcctcttaaagaaacccaaccacttgtgacccatacaccagctttttttctttactcccccgtctcttctaatacccatctcaactatcaattcttcaactcccaccccctccctcaacctctcaacaacagcacttcagaacccattcccctactatcttctcctcctcacaccagtctttcgattgacccctcatctgcacctcataacactaccaatgctacatcatatatctctattaccaattcctctcctatatctttttcactccctcccatcaacacccaccatatgactacaattacacaaacaagcaaaataaaaccttaaaaaaattttccactttctcatcacacttcctccgacaaacccattacctttaaacaagccatccaacattcccattggagaaaggcagcgtcagacaaatttataacacccttcaacagcaatggatatcgactcatgtaccacatcccctcaacaaaatgttttaggctgcaaatggacctttcgaatcatgcactataccgatagatctattgctcattacaaagccaggttggtagcccaagcttcaaacttcaacaagtactgaatttcaggaaacttttagctctattgtcaaattctctactattcacatgcttattgctttagccactaatgaacactgagatattaagcaatttgatgtttccaatacctttttacatgtcaaagtaaatattaatatatatgtcttaaccttctgattttacagattataaattatccgtaatatgtatgtaagttaactaaaacaatatatggcctcaaacaagtatcgaggcgatgatattcaatatttgtaactatttatatactcaaaagtttaaactcagcacttttgatcattccttgctcatatatcatcataacaatagtagtgtttatttacttctatatgttgatgacattcttatcgctgaaaattcaccgattgaaattaatcgcttaatacacatattattcaaacaatttaatgtaaaacagtttggttgtctctctcattttttcggtttgcaaattaataaaactgctactggctattttttacatcaaaccaactattaatctgatcttttaacaaaagccggtatgatgcaatccaaatctgttttaatgcctttaccacttctgctacacaaaaaccatattcattcttcacctctttccaatctacaacattataaacatctcattggtgccttacaataccttactgttactcgaccaaatataacttttagtgttaattttctaaatcagtatatgcatgattggactacccttcattttcaatttctcaaaagagtattaaggtattttaaaggcacttccaatcatggtctggcaatgacggctggaacgctttccctatatccttatgcaaatgcagattgggcaagtgatagcaatgatagaaaatcaacaacatgtttttgtacgtacctcggtcccaatttaatttcatggtcagcaaagagacaaaccactgttgcatgatcatctaaagaagctgaatattgtgctcttgacaccaccaccacagagattctatggctacaacgattacttcaagaacttacaaccataatcctgtttttcacgcaataacaaaatacattgaggtggattatcattttatcagatatcacatcaaactaaagcacatagtttttcaacacattatgactgaagatcagccaacaaatatcctcactaaagctctgacaaccaaaagacatcacgatcttgcaagcaagttgaccattcaacctctcgatgctcaacttgaagggggggtaataggacttatttgatgttttgctgatttggttgccgatcttctagttgctcatgctagctgcttttggttctcctctccagggctccagagcttcagcacagctccttgtgtcgcagatctcagctagggttattatcctgtaacacttttagctttttttattaaggaaattgtattccaaatgtctattgtgctcttttgctgtaaattacaagtttgctacttgtaatgtttctaaatagctttacctgtaacaaagtttgatataataaaaacttactttagtatttcattttccttctcttttttcttctctctgttatttcattttgactctatgaagtatattaactccataaaaatgaaagaatgcattttttttttcatttttgttagttttactcatttttaaatgtaaactggtttgaatgacattttcag

SEQ ID NO: 365 - DNA, 219 bp, Phalaenopsis equestris
  misc_feature: exon 3
gtggatgttgtggttacaactgctggtggcatagaagaagaccttataaagtgtcttgcaccgacatatagaggtgatttttctttacctggggcgtatcttcgctctaaaggattgaatagaattgggaacctgttggttcctaatgataattactgcagatttgagaattggatcactccaattcttgaccaaatgctagaagaacaatcaatgaag

SEQ ID NO: 366 - DNA, 2040 bp, Phalaenopsis equestris
  misc_feature: intron 3
gtacttttagcagtgttatttttaaaattctaatattaacagatggatgtggtaaaccaagaatgataaaatgtgtaataattatgccagagagcttgtggaattagcacttcttcaagacaatttcaattaataaaagttggcttagatgatttgaacatgtgcattagggaggaaaacatgcttttatatgattaattgatagtgttaatgcattgcaaaagaagtactagttcaaagatattttggctagaagttgtaaaaaatgtactgatgtaatcttcaattgatatttcatgcaaaactcaattgaaatgaagggagtagctcgtcatgcctatatcaaatagtctgtatgaatccgttgtttctctggttgcagttgctgatgatcattaatagttgaatagaaattggtttatattctgtcttaatatttttttgttgtgatgttctaggaaatactaaatgaattctattgcttttttgctgatattttttattcatttattcaagtttagttttcccatcatgttagtatttcttgagtggttttgcaaaattatatatgcaatgatttgctaatctagtgaccgttcagtcatttgtggttttcaaagtttagaacacatatgggagagatcggtaagctattggcatgcattaacaaggtgttatgaagtggaccattatgaacatttagtcatatcctgtctatttgtgatcagctttatatatatatatatatatatatatatataatgttacatgctattaaccgtttgaatattgttcggctcacttaatctgatggttgaatatattttctccaatgttcaaggcctagcacatgtgggggtatgtgtgagtttaaaacagaaaaaacatttgcatttatatcacataattattatccgtttacatatccaacacccaaactttcatatattcatgcataacactcaaatatctaaaattacataaaaaataccactacaactgacgtttaaatagtgaaattcactttttcatgcaaaaattatgacattagtgttataaatttaaatatctaactttaggtgttatatatgtaaatacatatgaattgtgcgatgtgtaagaaaaattttcaaaataaaaataacgaaaatcctgtgtgaaggtttttttttggcataatttttaagtatgttatttttattctatccctttttacatcctttaaatttctcaaaaatgtccatacaaaatccattttgtagagggtacagcttgcggcgaggtgtgaaatggatgctatttatattgaaatgtacttacatgaaggacacatgtacttatagaattgttccttttaaatgtttgttctattgcaaagctagcttattttcaactcttttagctagccctctttttttaactttttggcacagattaattcacccacacgatctccatggttacattgctgtctctgtttatgtcatgcttgatgaattatttattatgcagaattctttaatatgatcagaatatatatttgcaattttggttggctaaaagtctgtgtctaggcataaagcattttctcattattaacacaacatcatggtgtatcgttggagttcataagtgatatgtttttacttttcttttttttttttctaaagagacgtttgacttcttgacttagaaaatcgctttaatattatttttttgcagtttatattttacattatgatatattatgtttgacataattatggagaataggtgctttccagtatttaatttggtttccgggaaactttgtctgtgtgaaaaagtgtaattccaagaaaatatttctgattttttgtttcctacttttttgttaaatggccacagccacttaatttctcttcattctttccgcactatatatacatgacaattttcacttacaatccattattttaagatcaagtcatgttgcctctagttatccgcctacatctagttttttatttgcatcacatcttctattgcttgatgccacag

SEQ ID NO: 367 - DNA, 87 bp, Phalaenopsis equestris
  misc_feature: exon 4
gatgtgaattggacaccttcaaaagtgatttcacgcttgggaaaagaaataaatgatgaaagttcgtacttgtattgggcatataag

SEQ ID NO: 368 - DNA, 3009 bp, Phalaenopsis equestris
  misc_feature: intron 4
gtgattttattatcaaaattaatttctcagcttctttttttatggcagatgtctaaattatttctaagctgttggattatggcaatatattgcttgatgtttgattttatggaaaattatttcgatttcaggttacttttgcagagcactatgcttttcatgattctgagacgtgattattcaaccgtacaaaaaaaggtttttatgaatgaatagctttgaagaataaaaatagaagtgatgatttcctcagaacaggcggtggagcgaaagatgtgatttagctgttaatatttcatgataatttgctaaaaatgcaaactgaaagtttgaagctgactgggcttgaagtggggtaaaatactagctgcattaagaagatttcatacgagttttaggggagtttagaagttgatcaaacttaaaaaattctcgtagtcaagtgaagagctacaaaaaactattgaaaatagaaaattgggcaagtttttaagcaagaaagaaatgcgatgcaaaaaaatgacttgagcggtagaacaaatatcttgggactttgatcaacgtggtgaattaagaattaagcttgtagggtgcactaggctaactaagttgaagatcttcatagaaaaacaaactgaaagttttgaagttgactaggcctaaagtggggtaaaatactagttgcattaagaacattttcatatgaggtttgggggagtttcagaattgatcaaacttaaaagatgctcgttgtcaaatgaagagccacaaaaggttattgaataatagaaaattgggcaagtttcctagcatgaaagaattgatatgggaaaaataacttgagcaatagaataaatatcttgggactttgatcaatgcggtgaattaagagttaaggtagcagggtgcactagtctaactaagttgaagatcttcatgaaaggtaaaattgattgagaaattattaaatgatacactttacagaagaaattttctaaatgagaaaaatgaattagattttgaaggatgctgttggttaaaaaaatagtggtcttgaattggtgctgaagatgcataaagttaagattttaggcctaaatgagattcctatcgagatttggtagatatttgacaatataagtaacatacttttgaaattaagggaatgcttattgagcaagagcagttatggtaggcttattatggttcgtaaaatgaactatagagatgtttactattatgacgtatgggttatacggtgcagttgtgggaggctaattgaacaaagtttgtaaaatcgatttagtatcaagaagaaatttagttttatgccaagacttattatagatgtgttatttgtgtaatttaattaatggtgaaatttaaaaataaatgaacattgaaatagttttaatattatattgtttgatattgagaaggaatatggtcgagttgaacttgttgggcattaagattaaaggatgtgtgtgaaaggtttgtcatagttaggcaaacatatatgatgaagtagcatttaacaatagaaataattatggaacgttcaaaattcagtcatattaaggtaatatctatggtcaatgtcatcagtagccttacccaactatttgtggtttgctttatgaatccttaatttccattcacacaaatcatcttaaatgagttttatcagtgtaaccttagtttttatcctttttaatcatctgaaactaatattatttgcttgtctaatatgcatatttctgcctttagttacatacgtttaaatctctcaactctttgctaattattttcttcagtagctagctaatggcggtgggtgaattttttatgagattaactttcgaaaaagattatgaatcttaagtttaatgtttaagaaagtcttttttagttgaatgatgagtttggaggggtatattgttagaaatgctaagagtagtttatattgagttagttcaggttgatttagaagggttaatttgaggaatgagattttgatgagacaaatggctagaaatgtttattgtggatgagctcggaatgtgtagttgtgatatggtgtatggttaggttcgaagaattttaaataaatgttgatgagtagggaacgatatttggtcttactctcacctaatttggttgagagttacaggtggattttagagtagttgtgaggcttgggttgggtgttagacagatttggagaagttttaggatgcaaaggatgatgcttggttgatttggattaggtgtttaagggaggagagtagctaaattaaaataaaatgataactatctttagctcacaaaattaaagaaaattgtacaattcaagccatcacgttgcttgggttgatacaacttccatatagattttgacaatgttcttgggtctactacaacttactaataaatccactcaaccgtgttgcttgggttgatacaacaaatgattaactcgttgataattaataattggatataataaaattgtccctcaattaatcaataattttttaataatcaaaatagtgcccgactatttcatggggccgttttagtgtcagagtttaatgaactgccaaaatagtctcctgactttttaaattggggttgaaatgattttcatggagaacaactagaactcaattttaaaatagtcagggactatgttgacacttctataaacttagttactaatacggccccatgtaaatagtcggaagattattttggcactttactcaataattaatattttttcaaaagttttggatcgtctacttttctctcaattatgttataagctagtgctagctgatatatatccttcaatttgagttggaatgtcagtgtaggaagactatcttcaatataggaagagtgatgagtggtatatatttatttatgtattctctataacattgtactcgtttttctattataaataaaaggcttacaaagaaatgacttcaattaacttttcag

SEQ ID NO: 369 - DNA, 106 bp, Phalaenopsis equestris
  misc_feature: exon 5
aatggaatacctgtcttctgccctggactaactgatggatctcttggagacatgttgtattgtcatgcgataagaagcggtggtttgaatgttgacattgttcaag

SEQ ID NO: 370 - DNA, 82 bp, Phalaenopsis equestris
  misc_feature: intron 5
gtccttaacactcattatttacgtaatttacaatatttgttagtcttgttccttgataatttgcttctccctcttccttcag

SEQ ID NO: 371 - DNA, 236 bp, Phalaenopsis equestris
  misc_feature: exon 6
atatacgatccatgaatagcgaagctgttcgagctggtcttaggaagactggaatgattattctaggcggcggacttccaaaacaccatatttgtaatgccaacatgatgcgtaacggttcagattatgctgttttcatcaacaccgcacaagagtttgatggcagtgattcaggagctcagcctgatgaggctgtttcatggggaaaaataagagcctctgcaaaaacggtcaaa

SEQ ID NO: 372 - DNA, 292 bp, Phalaenopsis equestris
  misc_feature: intron 6
gtatgttttttatccttctcgttcgcacatttgatgcttattaatgatgttatatttacgtttgaactcatgctagtgcttcaaaaataaatttcaatgattgtgcattgggcatcttcttagacatgcacacttctggtaaattttgaagtaccaaatcaatccaaaaccaaaacaagatttaaataaaaactcatattatgttatgtttgtatcctcgaagtaattaacatcaacattctgttacatgttagtctgattttttttctaagtgttaagctaaaattctcag

SEQ ID NO: 373 - DNA, 309 bp, Phalaenopsis equestris
  misc_feature: exon 7
gtacactgcgatgcaaccattgctttccccctgcttgttgctgtaacatttgcaagaaggtttgaagatgcttctacttcggccgacattaaatccgactaaacccagtgagcttatccctcacctaagttaagatttcctcgttgtatttgtgctttctgtgactctggctaacattttgatcattagcggatagtttgagacagcttgtagggatcggttgttatgctgacaaaaaacaaaccatttaattaatatataattcaacatttttgaaatgttcctatttacaaaattaacattgccaat

SEQ ID NO: 374 - DNA, 2609 bp, Phaseolus vulgaris
aactacaccgtctctgttgcgttgcgcgcagaggagagagagagagagaggagagagagaataatggaagaaacaaagagaaaggaagaagaagtgctagcatcagctcactccacggtgttcaaagaatcagaaagccttgatggaaagtgtgctaagattgaaggctatgatttcaaccatggcgttaactatccgctgctactcaggtccatggccaccactggctttcaggcttcgaatctcggtgatgccatccaagtagttaatcaaatggtttgtttttgtctaaccccatttcttcatttagctgaatctgtgctttttcgcttataaagttgtgatttttgggctgaagctagattggaggctagttgatgaagccgtgactgaggattgcagtgaccatgagagggacttggagtaccgaaaatctgtgacttctaaagtgtttctgggtttcacttctaatcttatttcctctggtgttagagacattgttcggtttcttcttcagcatcgcatggtgagttactttcccttgttcaaatgccagttcaagcctttgcaatgtattcctcaatgtttctgatacaatcatgatcaaacagtaaattgaagtcaagttggtaaatttttatttgttttgcaatgttcaggttgatgtagttgttacaactacaggtggcattgaagaagatcttataaagtgccttgcaccaacattttcaggagatttctctctgcctggagcgtatctacgctcgaaagggttgaatcggattggtaatttgttggtccctaatgataactattgcaaatttgaggactggattattcctattttcgatcagatgttaaaggaacaaaatactgaggtattttattgtttgacttatctgttcaatgcaatgtaaaattatgtggtttggtttttgttgaactcctgctgtcacttttattactcatacttttgtgtttgtatttagtactatttgttattcatgtttagtttgtgctaaactaaaatcaaaccccataattcatgtttagtttgtattttgttctatgatcaaactaactaaactatgattttatgcatggttggatgaaaaaccttctacaaagcaggttctttttaagttttcacttgtgatttttttcttggtgccttttctgttcggcagaatgtgttgtggacaccatctaagttaatagctcggttgggaaaagaaataaacaacgaaagctcttacctttactgggcgtacaaggcaagtatgacaccaaattttaatggatcatgctactccctctactctgtttctgatttgaatctttttcctagtttctttctcgtaattagactgttcttgtccatgttttctagaacaacattccagttttctgtcctggcttaactgatggctcattgggggatatgctgtacttccattccttccgcaatcctggtctgattgtggacatagtgcaaggttttttccacactctttctgctttttactgcatattttgaaaaatctgggaaccatcactgaaatagttagcaatacaacagatataagggcaatgaatggtgaagctgttcatgcaaatcccaggaagacgggaatgatcattttaggaggtggccttccaaaacatcacatttgcaatgccaatatgatgcgcaatggagcagactatgctgtttttatcaatactgcacaagaatatgatggtagtgattctggagctcgtcctgatgaggctgtttcgtgggggaaaatccgtggatctgctaaaactgtcaaggtacatcctatgcatactttctcagcatgtttaagtttttaattttgtcatgcatactctcatacttcctttgcatgtttttgtcaatgtcatgcattttctcataatttccttttcatctgtttttactttgttgaacaatttccttttgaaacgggtataccatctgtgttaagcagttgaatatgcattggtttctatttatattacatgaacttgtaacctttatcataatgccagcacttaatagatatttaattactcaaacactctactaatacgcatgaaaaaactagggtaccaaacaaccatcattactatatccactaaatgtcttcttatacattaaaacaggtgcactgtgatgcgacaatagcattccctctgctggttgctgaaacgtttgcttccagagttaaacctcaccattgatggaggctaaacacgaatttgttgtaaagtttgatttagttgtgttgtgatttgatgatcttgacgtttgagttcgctgtgggtgcttaacatggcaatcattttattcttctgctgtacgtggcagaggacatcattccaaaataatccactgatcctggcattgtggaagtcgggaactgtagatgtagtcataatttttcattggagatgattgtacaaactaatcttatgagtgctgatagttgacaaccctgcatcaaattaactgaaaagagaaatgatattttgttgaaatggaacaattttgaaattttattggttaaatcacagttgtaaactgatatcttatcactgtgcaa

SEQ ID NO: 375 - DNA, 276 bp, Phaseolus vulgaris
  misc_feature: exon 1
aactacaccgtctctgttgcgttgcgcgcagaggagagagagagagagaggagagagagaataatggaagaaacaaagagaaaggaagaagaagtgctagcatcagctcactccacggtgttcaaagaatcagaaagccttgatggaaagtgtgctaagattgaaggctatgatttcaaccatggcgttaactatccgctgctactcaggtccatggccaccactggctttcaggcttcgaatctcggtgatgccatccaagtagttaatcaaatg

SEQ ID NO: 376 - DNA, 82 bp, Phaseolus vulgaris
  misc_feature: intron 1
gtttgtttttgtctaaccccatttcttcatttagctgaatctgtgctttttcgcttataaagttgtgatttttgggctgaag

SEQ ID NO: 377 - DNA, 168 bp, Phaseolus vulgaris
  misc_feature: exon 2
ctagattggaggctagttgatgaagccgtgactgaggattgcagtgaccatgagagggacttggagtaccgaaaatctgtgacttctaaagtgtttctgggtttcacttctaatcttatttcctctggtgttagagacattgttcggtttcttcttcagcatcgcatg

SEQ ID NO: 378 - DNA, 133 bp, Phaseolus vulgaris
  misc_feature: intron 2
gtgagttactttcccttgttcaaatgccagttcaagcctttgcaatgtattcctcaatgtttctgatacaatcatgatcaaacagtaaattgaagtcaagttggtaaatttttatttgttttgcaatgttcag

SEQ ID NO: 379 - DNA, 219 bp, Phaseolus vulgaris
  misc_feature: exon 3
gttgatgtagttgttacaactacaggtggcattgaagaagatcttataaagtgccttgcaccaacattttcaggagatttctctctgcctggagcgtatctacgctcgaaagggttgaatcggattggtaatttgttggtccctaatgataactattgcaaatttgaggactggattattcctattttcgatcagatgttaaaggaacaaaatactgag

SEQ ID NO: 380 - DNA, 309 bp, Phaseolus vulgaris
  misc_feature: intron 3
gtattttattgtttgacttatctgttcaatgcaatgtaaaattatgtggtttggtttttgttgaactcctgctgtcacttttattactcatacttttgtgtttgtatttagtactatttgttattcatgtttagtttgtgctaaactaaaatcaaaccccataattcatgtttagtttgtattttgttctatgatcaaactaactaaactatgattttatgcatggttggatgaaaaaccttctacaaagcaggttctttttaagttttcacttgtgatttttttcttggtgccttttctgttcggcag

SEQ ID NO: 381 - DNA, 87 bp, Phaseolus vulgaris
  misc_feature: exon 4
aatgtgttgtggacaccatctaagttaatagctcggttgggaaaagaaataaacaacgaaagctcttacctttactgggcgtacaag

SEQ ID NO: 382 - DNA, 116 bp, Phaseolus vulgaris
  misc_feature: intron 4
gcaagtatgacaccaaattttaatggatcatgctactccctctactctgtttctgatttgaatctttttcctagtttctttctcgtaattagactgttcttgtccatgttttctag

SEQ ID NO: 383 - DNA, 106 bp, Phaseolus vulgaris
  misc_feature: exon 5
aacaacattccagttttctgtcctggcttaactgatggctcattgggggatatgctgtacttccattccttccgcaatcctggtctgattgtggacatagtgcaag

SEQ ID NO: 384 - DNA, 83 bp, Phaseolus vulgaris
  misc_feature: intron 5
gttttttccacactctttctgctttttactgcatattttgaaaaatctgggaaccatcactgaaatagttagcaatacaacag

SEQ ID NO: 385 - DNA, 236 bp, Phaseolus vulgaris
  misc_feature: exon 6
atataagggcaatgaatggtgaagctgttcatgcaaatcccaggaagacgggaatgatcattttaggaggtggccttccaaaacatcacatttgcaatgccaatatgatgcgcaatggagcagactatgctgtttttatcaatactgcacaagaatatgatggtagtgattctggagctcgtcctgatgaggctgtttcgtgggggaaaatccgtggatctgctaaaactgtcaag

SEQ ID NO: 386 - DNA, 354 bp, Phaseolus vulgaris
  misc_feature: intron 6
gtacatcctatgcatactttctcagcatgtttaagtttttaattttgtcatgcatactctcatacttcctttgcatgtttttgtcaatgtcatgcattttctcataatttccttttcatctgtttttactttgttgaacaatttccttttgaaacgggtataccatctgtgttaagcagttgaatatgcattggtttctatttatattacatgaacttgtaacctttatcataatgccagcacttaatagatatttaattactcaaacactctactaatacgcatgaaaaaactagggtaccaaacaaccatcattactatatccactaaatgtcttcttatacattaaaacag

SEQ ID NO: 387 - DNA, 440 bp, Phaseolus vulgaris
  misc_feature: exon 7
gtgcactgtgatgcgacaatagcattccctctgctggttgctgaaacgtttgcttccagagttaaacctcaccattgatggaggctaaacacgaatttgttgtaaagtttgatttagttgtgttgtgatttgatgatcttgacgtttgagttcgctgtgggtgcttaacatggcaatcattttattcttctgctgtacgtggcagaggacatcattccaaaataatccactgatcctggcattgtggaagtcgggaactgtagatgtagtcataatttttcattggagatgattgtacaaactaatcttatgagtgctgatagttgacaaccctgcatcaaattaactgaaaagagaaatgatattttgttgaaatggaacaattttgaaattttattggttaaatcacagttgtaaactgatatcttatcactgtgcaa

SEQ ID NO: 388 - DNA, 2410 bp, Rosa chinensis
ttttcttaaaattataaacatttcttcttctttcagtgtagaacctcacaaccgccggttccttttccttgctcttcgttccaaggcgtcactctgtcagctcctctatatagccggaccactctttgccgccgcatcttcagccgccgccgtcagccgtaagtttctctcttccacctgaaattcaactcgccgctgtgaaaagcaattcaacttgttaaagacgattcctttacttgctgctttggatttcttgctcataatttcagagattctacttccaaaaccctagcgaaaagcaatggaagacggtaaaatcgcaagcgtgcactccacagtgttcaaagaatcagagaatttgcaaggcaaatgcagcgaaatcaaaggctacgatttcaacgagggactcgattactctcgtctcttcggttcgatgatcactactggtttccaagccaccaatctcggagaagccatcgaagtcgtcaaccaaatggtaaaattttctctccccgaaatgcccctgtcaatttgattgttttacggtaatgtcgttgtgattggactggtgggactgtgtagctagattggaggctggcagatgaggctgtagctgaggattgcggtgaggaggagagggatgggaagtttagggagtctgtcaagtgtaaagtgtttttggggttcacttcgaatttggtttcgtctgggcttagagatgtgtttaggtacttggtggagcaccatgcggtggatgtggtggtcacaactgctggtggcattgaggaggatcttatcaaatgccttgcgccgacttataagggtgatttcgctctagcaggggcgtatttgaggtccaagggattgaatcgtatcggtaatttactggttcctaatgataactattgcaaatttgaggattggatcttaccgattttcgatcagatgttgaaggaacagaatgaacaggcatgtgcccttgtctttttatttttttaaatgtggtttttgttggggggtttagtggttttgggttgtgattgaatgtttttgttttagcagaatgtgctgtggacgccatctaaattgattgcacgcttggggaaggaaataaatgatgaaagatcgtatctttactgggcatacaaggcaagtttcaaccaattcaaccactttatctttagctctatacactggtattgtttgattggcttaaagtctaaatctgcttggataatcacattcatagacgcatagttttgtggcattgtaatcagatgagttgtttgaatggcaatggttatattgcggccagtccactggtttcagttgtaagggcttcatctcaccgttataggggttgtctgtgcagtaagaactgattatttttcttttggatgtgttccagaacaatgtcccagtttactgtccatccataacagatggctcattgggagacatgttgtacttccattctttccgcagcccaggtctggttgttgacatagtgcaaggtatgttgcttgtcacattgtttctccagctgatagttagtagcttgagaaactcaactcacaaaacagcttgccctttgaacagatattagggccatgaatggtgaagctgttcgtgcaggtctgaggaagactggaatgatcatcctcggaggaggcctgcccaaacatcacatttgcaatgctaatatgatgcgcaatggtgctgattatgctgtgtttattaacactgcacaggagtatgatggtagtgattctggagctcgtcctgatgaggctgtctcctgggggaaaatacggggttctgccaaaactgttaaggtgtgtttagttttagccatgtcctaggtttgcacattgccttttagctttggttgcttgcttcataataatacatattcacccacccttcaattctttttaccctataccttgcatgcttgagtcttatcatcgtctattctgatttattttccttcctttttcttggttgaaccaggtgcactgtgatgcaacaattgttttcccttttctggttgctgagacatttgcaaagaaagttagcaagactacgacctagaatttcatgaagattggtttagaatatactgttatagtaggtcatggtaaacctgttaactggctgatgattgccattttgaggttgtatgttgtttgcaagatagggttaggcataccgcattgcatgattattattagaatcaacacattttcccccatatgttgttagtaagtgccttggttttggtatgtccttagaggctgagatgacaaactgggggcaattactttcatttgtaacgaatttgttccatttcatgttccaaatcctacatgaatgagaagctgatttacttctagctatcttgcttaaa

SEQ ID NO: 389 - DNA, 158 bp, Rosa chinensis
  misc_feature: exon 1
ttttcttaaaattataaacatttcttcttctttcagtgtagaacctcacaaccgccggttccttttccttgctcttcgttccaaggcgtcactctgtcagctcctctatatagccggaccactctttgccgccgcatcttcagccgccgccgtcagcc

SEQ ID NO: 390 - DNA, 111 bp, Rosa chinensis
  misc_feature: intron 1
gtaagtttctctcttccacctgaaattcaactcgccgctgtgaaaagcaattcaacttgttaaagacgattcctttacttgctgctttggatttcttgctcataatttcag

SEQ ID NO: 391 - DNA, 227 bp, Rosa chinensis
  misc_feature: exon 2
agattctacttccaaaaccctagcgaaaagcaatggaagacggtaaaatcgcaagcgtgcactccacagtgttcaaagaatcagagaatttgcaaggcaaatgcagcgaaatcaaaggctacgatttcaacgagggactcgattactctcgtctcttcggttcgatgatcactactggtttccaagccaccaatctcggagaagccatcgaagtcgtcaaccaaatg

SEQ ID NO: 392 - DNA, 86 bp, Rosa chinensis
  misc_feature: intron 2
gtaaaattttctctccccgaaatgcccctgtcaatttgattgttttacggtaatgtcgttgtgattggactggtgggactgtgtag

SEQ ID NO: 393 - DNA, 387 bp, Rosa chinensis
  misc_feature: exon 3
ctagattggaggctggcagatgaggctgtagctgaggattgcggtgaggaggagagggatgggaagtttagggagtctgtcaagtgtaaagtgtttttggggttcacttcgaatttggtttcgtctgggcttagagatgtgtttaggtacttggtggagcaccatgcggtggatgtggtggtcacaactgctggtggcattgaggaggatcttatcaaatgccttgcgccgacttataagggtgatttcgctctagcaggggcgtatttgaggtccaagggattgaatcgtatcggtaatttactggttcctaatgataactattgcaaatttgaggattggatcttaccgattttcgatcagatgttgaaggaacagaatgaacag

SEQ ID NO: 394 - DNA, 93 bp, Rosa chinensis
  misc_feature: intron 3
gcatgtgcccttgtctttttatttttttaaatgtggtttttgttggggggtttagtggttttgggttgtgattgaatgtttttgttttagcag

SEQ ID NO: 395 - DNA, 87 bp, Rosa chinensis
  misc_feature: exon 4
aatgtgctgtggacgccatctaaattgattgcacgcttggggaaggaaataaatgatgaaagatcgtatctttactgggcatacaag

SEQ ID NO: 396 - DNA, 259 bp, Rosa chinensis
  misc_feature: intron 4
gcaagtttcaaccaattcaaccactttatctttagctctatacactggtattgtttgattggcttaaagtctaaatctgcttggataatcacattcatagacgcatagttttgtggcattgtaatcagatgagttgtttgaatggcaatggttatattgcggccagtccactggtttcagttgtaagggcttcatctcaccgttataggggttgtctgtgcagtaagaactgattatttttcttttggatgtgttccag

SEQ ID NO: 397 - DNA, 106 bp, Rosa chinensis
  misc_feature: exon 5
aacaatgtcccagtttactgtccatccataacagatggctcattgggagacatgttgtacttccattctttccgcagcccaggtctggttgttgacatagtgcaag

SEQ ID NO: 398 - DNA, 85 bp, Rosa chinensis
  misc_feature: intron 5
gtatgttgcttgtcacattgtttctccagctgatagttagtagcttgagaaactcaactcacaaaacagcttgccctttgaacag

SEQ ID NO: 399 - DNA, 236 bp, Rosa chinensis
  misc_feature: exon 6
atattagggccatgaatggtgaagctgttcgtgcaggtctgaggaagactggaatgatcatcctcggaggaggcctgcccaaacatcacatttgcaatgctaatatgatgcgcaatggtgctgattatgctgtgtttattaacactgcacaggagtatgatggtagtgattctggagctcgtcctgatgaggctgtctcctgggggaaaatacggggttctgccaaaactgttaag

SEQ ID NO: 400 - DNA, 178 bp, Rosa chinensis
  misc_feature: intron 6
gtgtgtttagttttagccatgtcctaggtttgcacattgccttttagctttggttgcttgcttcataataatacatattcacccacccttcaattctttttaccctataccttgcatgcttgagtcttatcatcgtctattctgatttattttccttcctttttcttggttgaaccag

SEQ ID NO: 401 - DNA, 397 bp, Rosa chinensis
  misc_feature: exon 7
gtgcactgtgatgcaacaattgttttcccttttctggttgctgagacatttgcaaagaaagttagcaagactacgacctagaatttcatgaagattggtttagaatatactgttatagtaggtcatggtaaacctgttaactggctgatgattgccattttgaggttgtatgttgtttgcaagatagggttaggcataccgcattgcatgattattattagaatcaacacattttcccccatatgttgttagtaagtgccttggttttggtatgtccttagaggctgagatgacaaactgggggcaattactttcatttgtaacgaatttgttccatttcatgttccaaatcctacatgaatgagaagctgatttacttctagctatcttgcttaaa

SEQ ID NO: 402 - DNA, 2410 bp, Rosa chinensis; identical to SEQ ID NO: 388

SEQ ID NO: 403 - DNA, 158 bp, Rosa chinensis; identical to SEQ ID NO: 389
  misc_feature: exon 1

SEQ ID NO: 404 - DNA, 111 bp, Rosa chinensis; identical to SEQ ID NO: 390
  misc_feature: intron 1

SEQ ID NO: 405 - DNA, 227 bp, Rosa chinensis; identical to SEQ ID NO: 391
  misc_feature: exon 2

SEQ ID NO: 406 - DNA, 90 bp, Rosa chinensis
  misc_feature: intron 2
gtaaaattttctctccccgaaatgcccctgtcaatttgattgttttacggtaatgtcgttgtgattggactggtgggactgtgtagctag

SEQ ID NO: 407 - DNA, 383 bp, Rosa chinensis
  misc_feature: exon 3
attggaggctggcagatgaggctgtagctgaggattgcggtgaggaggagagggatgggaagtttagggagtctgtcaagtgtaaagtgtttttggggttcacttcgaatttggtttcgtctgggcttagagatgtgtttaggtacttggtggagcaccatgcggtggatgtggtggtcacaactgctggtggcattgaggaggatcttatcaaatgccttgcgccgacttataagggtgatttcgctctagcaggggcgtatttgaggtccaagggattgaatcgtatcggtaatttactggttcctaatgataactattgcaaatttgaggattggatcttaccgattttcgatcagatgttgaaggaacagaatgaacag

SEQ ID NO: 408 - DNA, 93 bp, Rosa chinensis; identical to SEQ ID NO: 394
  misc_feature: intron 3

SEQ ID NO: 409 - DNA, 87 bp, Rosa chinensis; identical to SEQ ID NO: 395
  misc_feature: exon 4

SEQ ID NO: 410 - DNA, 259 bp, Rosa chinensis; identical to SEQ ID NO: 396
  misc_feature: intron 4

SEQ ID NO: 411 - DNA, 106 bp, Rosa chinensis; identical to SEQ ID NO: 397
  misc_feature: exon 5

SEQ ID NO: 412 - DNA, 85 bp, Rosa chinensis; identical to SEQ ID NO: 398
  misc_feature: intron 5

SEQ ID NO: 413 - DNA, 236 bp, Rosa chinensis; identical to SEQ ID NO: 399
  misc_feature: exon 6

SEQ ID NO: 414 - DNA, 178 bp, Rosa chinensis; identical to SEQ ID NO: 400
  misc_feature: intron 6

SEQ ID NO: 415 - DNA, 397 bp, Rosa chinensis; identical to SEQ ID NO: 401
  misc_feature: exon 7

SEQ ID NO: 416 - DNA, 3992 bp, Sorghum bicolor
atggccggcgcgggaggcagcgggggcggcggcgtggtccgcgacgtggaggcgctggacggcgtgcgctccatcgtgctaaagccttcggagtcgctcgacgagtcgcggttcaccaggatcgccggcgccgacttcaacgacccgggcctcggactcgaggggctgcttgcctcgcttgcgagcacggggttccaggcatccaacctcggcgacgccatcgacgtcgtcaaccagatggtacgtcggccgctacgctgctggttttcgtccggagggcgagtttgcgcttgtgggataactgtagcaacctagcgaagtagataggttcatgtgaatttgtgcgatgcgaggtctgttgtagtgtgttttctgttgaatctcggcaaattaatgtttagacgcttggattttgttatggaatgcttggaggttgaattcgtaaacacggccaggctgatagatgtccagctgttacaacttcagtgatgtaggtatatttgaatttgcggtaacagtgaaaggacccaagtgtactagtacagaccttcaggcattggcaggtcctatgcgagttaaagttttcacctaattggagcaaacaggcataaaattgctagggaagtttctgctcttattgtatactacactgctttgctgtcaagtaaacatttgtagctggacttacctttggtttaaggtagaactacctacgtcacaaaaatatctttgctcttacaatatttcctcaccatattaattcattttcagttcttttcgaattcgctactattgtttccaaggttctgatatttgctatgcttgtctgaactaaagttagattggaggttatctcatgagaagcccagtgaggattgtgatgacgctgaacttgaccctaaatatagagaatctgtgaaatgcaagatatttctgggcttcacttcaaacctcgtgtcttctggcatccgggatataatccgttttctagctcagcatcacatggtaaattctccaactctgtttcacaagtgcaaattccgattgaaaagaagtttttgatgtccctttgtaaagtggtctgcttgaagcatgccttgacatatctgcttctaacattactagatgcattgagctttaggtttctaatgtcactaactttatctatgatgaaaaattatgctctttaggtggatgttattgttacaagtgctgggggtatagaggaggatctcattaaatgccttgcaccaacttatagaggtgatttttctttacctggagcactgctgcggtcaaaaggactgaaccggataggaaatctgttggtgcccaacgataactattgcaagtttgagaactggatcatgccactctttgaccagatgcttctggagcaatctactgaggtaagcatccctgctgggtcaaagcaatataatatttcttccggctgaaacaaaggtacctgctaaccatagctttcgtttgctgtatacaatggctattagatactataagtgtaatatgaatatgctttttttgcaacctgtaaaatgtttcttatggagggctgtagattttcctactgtctgagccaagcaggaaagaaaagcctaacatggaatcgatctacgatctggatcccaaagttctttaaaaactatttgtgtagcatgtcacacttaatatactaaaaaagttaaaatatattggcatttgcttgacctttcttgaatagcttcttttttatcgacattatactttttctggcctttagagtgatgagtgatgaccttcttttttctctttctagcaatatgcatatgaacttgaacagccagacaagtgagatcttgccaaaccaaatgtttgaagtatgaactattagtttctgcagaagttgctgaatatcaatacagagaaggttacaccttactggatatttgatgtaactcaggagcagcctgcatttcccacatcaataatgttttgtaatagatcacctgccatctctggtgtatcagtaattgatcttgttttttctgaaacaagaagtgaaccatatttatgtctttgtcatggatcaatttattgtttcttgcagaatgtttggacaccgtcaaaggtgatagctcgtcttggcaaagaaataaatgatgaaagctcctatctttattgggcatacaaggtaacatgtagctgtgcattcttaggaagtattaaaagaacttcagaaatgggagtgttttgattctattcatgaattatggaatgatttctgttggtaacaatgagatatgaagttttttgttatggccggcatccactactctaggcgccagcccattagtggctaggtggcgccatctgttaggggctaatagcccaagatgagctcttttatttatttcctcaggtagaatatttattccttaaaaataggatcttatagatggaagtctaggatgataaatatcttgtaaacattgattggagaaattaaacaaagcaacaacttggttgctcggcttcctcagaagccctagccgccctctctgtctcctggtgccgtgatcactacggcgccaactcgccgccgccacctgcgaaagccacgccctcctctcttccatccctacaatctccgcagcaactccggtaggatcactagccctatcatttttgttcctctttatttgtttatggtgttttttaggggggtggggtggggatgtgaaaagtaataaaagttctgcggagttatgtgagcaagttattgttgctttaccgtgggatctattttttcactgtcccagggtcatgtattttctccagatagttgcttttcctgacttgaaccttcccatctcgttgattaatgcagcttgtttgtatacctgatatctatattcaaacctttgtttagaattgttcagagcttagtagatggaagcagtataaagtagctattattcttaatattagaacaaactctaggttacccttccctgttccaggtagaatatcttttgcattgaagtttgtgcttttcttatactggagttcttaatttcacgagctactttgttgatttacatctcaagacaatagtcacactgtactaactcatcagtacttgaccagaataacattcctgtatactgcccagcgttgactgatggatcacttggagacatgctgttctgtcatgcagttcgtaatcctggccttattattgacattgtacaaggtatgattcactgttctgtccttgcctttgctttcttatgcaacattgaacttgaaatctttacagatatacgactgatgaatggggaagccatccatgcaacaccaaggaagacagggattatagttcttggtggaggacttccaaagcatcatatatgcaatgccaatatgttccgcaatggtgcagattatgctgtctatattaacacggcccaagagtttgatggtagcgattccggagcacaccctgatgaagcagtctcatggggcaagatcaagggttcagcaaaacctgtaaaggtataagctctagttaagcttactttggtaaacatcatgttgcaccttgctgttgatttgtcttgcagtgaggtatcaaaataaccgaaaagtatatttaaagatatttcttgatttctaaaacatcttaactaacttatgtcactgtggacaacttttgcactgacagaatttagcacgttgcattttgggcttgaaacatgcaccatcttactttctttaataattgtaatggattatgaattattatctgattgtataattgtgccttttctgctaatagaagatatcaattagaaatcagcatataaatgttagtctaacaatctaatctattgtttgaaaatttggaaatgtaggtgcactgcgatgcaagcatcgctttcccgcttcttgttgctgcgacatttgcacgtaaggttcacagctccaaatga

SEQ ID NO: 417 - DNA, 240 bp, Sorghum bicolor
  misc_feature: exon 1
atggccggcgcgggaggcagcgggggcggcggcgtggtccgcgacgtggaggcgctggacggcgtgcgctccatcgtgctaaagccttcggagtcgctcgacgagtcgcggttcaccaggatcgccggcgccgacttcaacgacccgggcctcggactcgaggggctgcttgcctcgcttgcgagcacggggttccaggcatccaacctcggcgacgccatcgacgtcgtcaaccagatg

SEQ ID NO: 418 - DNA, 597 bp, Sorghum bicolor
  misc_feature: intron 1
gtacgtcggccgctacgctgctggttttcgtccggagggcgagtttgcgcttgtgggataactgtagcaacctagcgaagtagataggttcatgtgaatttgtgcgatgcgaggtctgttgtagtgtgttttctgttgaatctcggcaaattaatgtttagacgcttggattttgttatggaatgcttggaggttgaattcgtaaacacggccaggctgatagatgtccagctgttacaacttcagtgatgtaggtatatttgaatttgcggtaacagtgaaaggacccaagtgtactagtacagaccttcaggcattggcaggtcctatgcgagttaaagttttcacctaattggagcaaacaggcataaaattgctagggaagtttctgctcttattgtatactacactgctttgctgtcaagtaaacatttgtagctggacttacctttggtttaaggtagaactacctacgtcacaaaaatatctttgctcttacaatatttcctcaccatattaattcattttcagttcttttcgaattcgctactattgtttccaaggttctgatatttgctatgcttgtctgaactaaag

SEQ ID NO: 419 - DNA, 168 bp, Sorghum bicolor
  misc_feature: exon 2
ttagattggaggttatctcatgagaagcccagtgaggattgtgatgacgctgaacttgaccctaaatatagagaatctgtgaaatgcaagatatttctgggcttcacttcaaacctcgtgtcttctggcatccgggatataatccgttttctagctcagcatcacatg

SEQ ID NO: 420 - DNA, 185 bp, Sorghum bicolor
  misc_feature: intron 2
gtaaattctccaactctgtttcacaagtgcaaattccgattgaaaagaagtttttgatgtccctttgtaaagtggtctgcttgaagcatgccttgacatatctgcttctaacattactagatgcattgagctttaggtttctaatgtcactaactttatctatgatgaaaaattatgctctttag

SEQ ID NO: 421 - DNA, 219 bp, Sorghum bicolor
  misc_feature: exon 3
gtggatgttattgttacaagtgctgggggtatagaggaggatctcattaaatgccttgcaccaacttatagaggtgatttttctttacctggagcactgctgcggtcaaaaggactgaaccggataggaaatctgttggtgcccaacgataactattgcaagtttgagaactggatcatgccactctttgaccagatgcttctggagcaatctactgag

SEQ ID NO: 422 - DNA, 698 bp, Sorghum bicolor
  misc_feature: intron 3
gtaagcatccctgctgggtcaaagcaatataatatttcttccggctgaaacaaaggtacctgctaaccatagctttcgtttgctgtatacaatggctattagatactataagtgtaatatgaatatgctttttttgcaacctgtaaaatgtttcttatggagggctgtagattttcctactgtctgagccaagcaggaaagaaaagcctaacatggaatcgatctacgatctggatcccaaagttctttaaaaactatttgtgtagcatgtcacacttaatatactaaaaaagttaaaatatattggcatttgcttgacctttcttgaatagcttcttttttatcgacattatactttttctggcctttagagtgatgagtgatgaccttcttttttctctttctagcaatatgcatatgaacttgaacagccagacaagtgagatcttgccaaaccaaatgtttgaagtatgaactattagtttctgcagaagttgctgaatatcaatacagagaaggttacaccttactggatatttgatgtaactcaggagcagcctgcatttcccacatcaataatgttttgtaatagatcacctgccatctctggtgtatcagtaattgatcttgttttttctgaaacaagaagtgaaccatatttatgtctttgtcatggatcaatttattgtttcttgcag

SEQ ID NO: 423 - DNA, 84 bp, Sorghum bicolor
  misc_feature: exon 4
aatgtttggacaccgtcaaaggtgatagctcgtcttggcaaagaaataaatgatgaaagctcctatctttattgggcatacaag

SEQ ID NO: 424 - DNA, 956 bp, Sorghum bicolor
  misc_feature: intron 4
gtaacatgtagctgtgcattcttaggaagtattaaaagaacttcagaaatgggagtgttttgattctattcatgaattatggaatgatttctgttggtaacaatgagatatgaagttttttgttatggccggcatccactactctaggcgccagcccattagtggctaggtggcgccatctgttaggggctaatagcccaagatgagctcttttatttatttcctcaggtagaatatttattccttaaaaataggatcttatagatggaagtctaggatgataaatatcttgtaaacattgattggagaaattaaacaaagcaacaacttggttgctcggcttcctcagaagccctagccgccctctctgtctcctggtgccgtgatcactacggcgccaactcgccgccgccacctgcgaaagccacgccctcctctcttccatccctacaatctccgcagcaactccggtaggatcactagccctatcatttttgttcctctttatttgtttatggtgttttttaggggggtggggtggggatgtgaaaagtaataaaagttctgcggagttatgtgagcaagttattgttgctttaccgtgggatctattttttcactgtcccagggtcatgtattttctccagatagttgcttttcctgacttgaaccttcccatctcgttgattaatgcagcttgtttgtatacctgatatctatattcaaacctttgtttagaattgttcagagcttagtagatggaagcagtataaagtagctattattcttaatattagaacaaactctaggttacccttccctgttccaggtagaatatcttttgcattgaagtttgtgcttttcttatactggagttcttaatttcacgagctactttgttgatttacatctcaagacaatagtcacactgtactaactcatcagtacttgaccag

SEQ ID NO: 425 - DNA, 106 bp, Sorghum bicolor
  misc_feature: exon 5
aataacattcctgtatactgcccagcgttgactgatggatcacttggagacatgctgttctgtcatgcagttcgtaatcctggccttattattgacattgtacaag

SEQ ID NO: 426 - DNA, 66 bp, Sorghum bicolor
  misc_feature: intron 5
gtatgattcactgttctgtccttgcctttgctttcttatgcaacattgaacttgaaatctttacag

SEQ ID NO: 427 - DNA, 236 bp, Sorghum bicolor
  misc_feature: exon 6
atatacgactgatgaatggggaagccatccatgcaacaccaaggaagacagggattatagttcttggtggaggacttccaaagcatcatatatgcaatgccaatatgttccgcaatggtgcagattatgctgtctatattaacacggcccaagagtttgatggtagcgattccggagcacaccctgatgaagcagtctcatggggcaagatcaagggttcagcaaaacctgtaaag

SEQ ID NO: 428 - DNA, 359 bp, Sorghum bicolor
  misc_feature: intron 6
gtataagctctagttaagcttactttggtaaacatcatgttgcaccttgctgttgatttgtcttgcagtgaggtatcaaaataaccgaaaagtatatttaaagatatttcttgatttctaaaacatcttaactaacttatgtcactgtggacaacttttgcactgacagaatttagcacgttgcattttgggcttgaaacatgcaccatcttactttctttaataattgtaatggattatgaattattatctgattgtataattgtgccttttctgctaatagaagatatcaattagaaatcagcatataaatgttagtctaacaatctaatctattgtttgaaaatttggaaatgtag

SEQ ID NO: 429 - DNA, 78 bp, Sorghum bicolor
  misc_feature: exon 7
gtgcactgcgatgcaagcatcgctttcccgcttcttgttgctgcgacatttgcacgtaaggttcacagctccaaatga

SEQ ID NO: 430 - DNA, 5193 bp, Solanum lycopersicum
cgcagaaactcgcggcggcagtcttgttccgtacataatcttggtctgcaataatgggagaagctctgaagtacagtatcatggactcagtaagatcggtagttttcaaagaatccgaaaatctagaaggttcttgcactaaaatcgagggctacgacttcaataaaggcgttaactatgctgagctgatcaagtccatggtttccactggtttccaagcatctaatcttggtgacgccattgcaattgttaatcaaatggtcagattcacttctttcttttaatttacgctaaaaaatttgttgctttatgcaaattttcatatttccgtatcaagattttttttccagctcctatgatattgaatttttttcacctcatccgcatatttttttgggcttagtaataaagttaattgctttacaccgacaatatttgggtttcaactactctctccttcccattttatatgactggaaacagagtttaagatgttagattgacttaatattagtatgtcattagtcttggtagagaaattatcacaatgaagttttattttgctgtaattaatttggattctaaaagatcatgaaagttgtatagatatggaataatatcagtcatgttttggaagtcatgaaatatagcaagtagcagtggaacggtgaaagttaaaaatttagagttgatagaatagttttgtaggcaaagtatgttaaaagaattaatcctaaaatagaaagaatgctaattaagttggaattggtgggtatagatagtatgattcatggtacttgtatgcaaattggaagtatgtaagacttatttcaattcaattaatatctgaatttacttcggaaaatctgttcaccctcacaagttaaacctcaccgatcttttaacagttgatgatagtgcttcttaaaaaatgttttgactttttataaacaggttacgttctttcatacacttggaagttgttgaactagttttgaagttcttaaaattgattctagaagtttgaaatttgtgtttttgtttgggggtgtgatgggtttgaagctagattggaggctttcacatgagctgcccacggaggattgcagtgaagaagaaagagatgttgcatacagagagtcggtaacctgcaaaatcttcttggggttcacttcaaaccttgtttcttctggtgttagagacactgtccgctaccttgttcagcaccggatggtgagttgcatttaagtaacagttccagtcgtttctgttctactaattcttttaagtctgactgtgttgtaccattaagtttgaatcttgtgggcttcttttatttgagatcatcttaatatatcttctcaatttttttatgtcctctccgtgtacactctaaagctatacttaccacactaatactatgacatcctcttattcaacctcaatactcttcatatgatttattatgtcaagcactgaatcgctgctatgcttggtttgtattaattgaagatcaagccttttgacattatttctcatgttccctatattccttgtctctctgatttattggttacaaaaactagaatacctcatccttctatctgccacacaagtactaaatgatatggtagaaaattattatctttgcgtcttagatttcagctctcatgtttagcattggtctaaagaaacttttgttaccatatggaacaattttctattaattattgtgtcttggaccttagcaaactgtcttccctccctgcaggttgatgttgtggttactacagctggtggtattgaagaggatctcataaagtgcctcgcaccaacctacaagggggacttctctttacctggagcttctctacgatcgaaaggattgaaccgtattggtaacttattggttcctaatgacaactactgcaaatttgagaattggatcatcccagtttttgaccaaatgtatgaggagcagattaatgaggtatccgctcttgtctgattcagtgttagatcatcccattacttgtttaatattggctgaagctttaacattcaatctggattctgctattactttcaaatacaaatggattttttacttgggtcattgcgtttgtgatattctttcaaatgtgataatacttatcttagctttggcttgtgatgatttgtttatcttctttttgtgatacagaaggttctatggacaccatctaaagtcattgctcgtctgggtaaagaaattaatgatgaaacctcatacttgtattgggcttacaaggtacatttctaatcacttccctttcattacatatttgatgaaattgtaatactcaagttagaatgccaaatctgtcccacatatataatagttacctctccgccgtttcattttgtaaggtgcttttcaaatcacttcccttccgttccatatttgatgaaattaaattggtgaagttagaatgccaaatgatctagctagtcccacatatataattaattattagttacgacttcccctttccattttattggcatagtttgattggacatgaagtttataactgtaaagaatactgttgaatcttgtgtcataaactaaattttgtatatcatgccaaaaatatccgttgaatcttgtgctcttaaatatgtcatgtcatttatgtaagtgagtggggagtgttattaagggtatgttgaagttaaaaacttactaaatatagaaagagacattctttttagacaaactaaaacgagaaggcacataaattgaaatggagggagtaatattgggatgatattttgataaatgagaaagtaagagatatttacctgggagaaaatggatttgcatgcattgtggtagcaaattcatcgttattgagatcagaaagtgaaatcaagagggaaggataaaaggagaagaaaccttcattttttattttttttgaaataatgaggattcatctagctgaccccatcccgtttgtgactgaggcgtagctgttattttcctatattttttttgtttagacgccatagaaccccttaaactatttcctttgaattcaagaaagaaaaagaagtacaacattatatagaaggaaaaagaaagtttaaaaaaggatggatacaacttcagaattctggcagatttttgcaatacttaatttggaggatatcttttgtgcagaaaacatcaataacagttttttctcttatcagatcctttctgcttgccaaatgcacaaaacttcaggaaagtagcttctatcattattcccaggttttccttgcaattaagtagtacctttgtcattctaggtactaaacgttgttatagttttcgtctttcaggtgggaataatagggatagggttgaggatatcttccggaacacctagctgttgttttctggaaaatattgacttttacctagcaaactttacattagtactcaatagggaagaacagaataggataggtctctttccaaagggggggggggtatgaattgaaacacaataccttattttttggatggaaaattaagtcatcctagttaatcttattattattattttggtttttggactcggctgatgttgtaaatagttcagcaatctatcttagtgctgttttgacaaactgaaaatcctattaccttctcaaaaataaaaaggatgtagaaatacctgttttatctctagatattccaagtgaagttttttcacaagcagaaatattttgaatttctaatagaataaatcttgtttccatgaagtttctaaagtttgcccctacaactttatttttttctttcaatccggaatttgctgtagttgcacgttggggtgtgataccagaatactagacaatgggatgaactaaggcatgatctcactattatccattccactatactgatttaaagcccagcgattgacatattatgataatttttggatgatcagaattcagaggttcatcgtggaaattttttgaatttttacttgggcagtttctcgggaagtcatattcactctattatgaagaagggatgatttcatgctttttcagcccagaaaataaaaggaaaacatgcattctcttttagttcatatattaatgttactctcgtatttatcatctcagaaccggattcctgtcttctgtcctggcttgacggatggatcacttggtgacatgctatacttccattctttcaaaaagggtgatccagataatccagatcttaatcctggtctagtcatagacattgtaggaggtatgagtatcttatcaagtgattctttcctctcatcaagaatttgtttgatgaaagagctaacatgattaagttatataaccagatattagggccatgaatggtgaagctgtccatgctggtttgaggaagacaggaatgattatactgggtggagggctgcctaagcaccatgtttgcaatgccaatatgatgcgcaatggtgcagattttgccgtcttcattaacaccgcacaagagtttgatggtagtgactctggtgcccgtcctgatgaagctgtatcatggggaaagatacgtggtggtgccaagactgtgaaggttaacaacttacctctaatacattttgtgcaagcatctcctttgtgagattctaatttgttgtagtgtttttgatttgttgaatgcaggtgcattgtgatgcaaccattgcatttcccatattagtagctgagacatttgcagctaagagtaaggaattctcccagataaggtgccaagtttgaacattgaggaagctgtccttccgaccacacatatgaattgctagcttttgaagccaacttgctagtgtgcagcaccatttattctgcaaaactgactagagagcagggtatattcctctaccccgagttagacgacatcctgtatggttcaaattaattatttttctccccttcacaccatgttatttagttctcttcctcttcgaaagtgaagagcttagatgttcataggttttgaattatgttggaggttggtgataactgactagtcctcttaccatatagataatgtatccttgtactatgagattttgggtgtgtttgataccaaggaaaaatgtttatttggaaaacaattggatttttaatttattttttcttgtttaa

SEQ ID NO: 431 - DNA, 260 bp, Solanum lycopersicum
  misc_feature: exon 1
cgcagaaactcgcggcggcagtcttgttccgtacataatcttggtctgcaataatgggagaagctctgaagtacagtatcatggactcagtaagatcggtagttttcaaagaatccgaaaatctagaaggttcttgcactaaaatcgagggctacgacttcaataaaggcgttaactatgctgagctgatcaagtccatggtttccactggtttccaagcatctaatcttggtgacgccattgcaattgttaatcaaatg

SEQ ID NO: 432 - DNA, 805 bp, Solanum lycopersicum
  misc_feature: intron 1
gtcagattcacttctttcttttaatttacgctaaaaaatttgttgctttatgcaaattttcatatttccgtatcaagattttttttccagctcctatgatattgaatttttttcacctcatccgcatatttttttgggcttagtaataaagttaattgctttacaccgacaatatttgggtttcaactactctctccttcccattttatatgactggaaacagagtttaagatgttagattgacttaatattagtatgtcattagtcttggtagagaaattatcacaatgaagttttattttgctgtaattaatttggattctaaaagatcatgaaagttgtatagatatggaataatatcagtcatgttttggaagtcatgaaatatagcaagtagcagtggaacggtgaaagttaaaaatttagagttgatagaatagttttgtaggcaaagtatgttaaaagaattaatcctaaaatagaaagaatgctaattaagttggaattggtgggtatagatagtatgattcatggtacttgtatgcaaattggaagtatgtaagacttatttcaattcaattaatatctgaatttacttcggaaaatctgttcaccctcacaagttaaacctcaccgatcttttaacagttgatgatagtgcttcttaaaaaatgttttgactttttataaacaggttacgttctttcatacacttggaagttgttgaactagttttgaagttcttaaaattgattctagaagtttgaaatttgtgtttttgtttgggggtgtgatgggtttgaag

SEQ ID NO: 433 - DNA, 168 bp, Solanum lycopersicum
  misc_feature: exon 2
ctagattggaggctttcacatgagctgcccacggaggattgcagtgaagaagaaagagatgttgcatacagagagtcggtaacctgcaaaatcttcttggggttcacttcaaaccttgtttcttctggtgttagagacactgtccgctaccttgttcagcaccggatg

SEQ ID NO: 434 - DNA, 538 bp, Solanum lycopersicum
  misc_feature: intron 2
gtgagttgcatttaagtaacagttccagtcgtttctgttctactaattcttttaagtctgactgtgttgtaccattaagtttgaatcttgtgggcttcttttatttgagatcatcttaatatatcttctcaatttttttatgtcctctccgtgtacactctaaagctatacttaccacactaatactatgacatcctcttattcaacctcaatactcttcatatgatttattatgtcaagcactgaatcgctgctatgcttggtttgtattaattgaagatcaagccttttgacattatttctcatgttccctatattccttgtctctctgatttattggttacaaaaactagaatacctcatccttctatctgccacacaagtactaaatgatatggtagaaaattattatctttgcgtcttagatttcagctctcatgtttagcattggtctaaagaaacttttgttaccatatggaacaattttctattaattattgtgtcttggaccttagcaaactgtcttccctccctgcag

SEQ ID NO: 435 - DNA, 219 bp, Solanum lycopersicum
  misc_feature: exon 3
gttgatgttgtggttactacagctggtggtattgaagaggatctcataaagtgcctcgcaccaacctacaagggggacttctctttacctggagcttctctacgatcgaaaggattgaaccgtattggtaacttattggttcctaatgacaactactgcaaatttgagaattggatcatcccagtttttgaccaaatgtatgaggagcagattaatgag

SEQ ID NO: 436 - DNA, 213 bp, Solanum lycopersicum
  misc_feature: intron 3
gtatccgctcttgtctgattcagtgttagatcatcccattacttgtttaatattggctgaagctttaacattcaatctggattctgctattactttcaaatacaaatggattttttacttgggtcattgcgtttgtgatattctttcaaatgtgataatacttatcttagctttggcttgtgatgatttgtttatcttctttttgtgatacag

SEQ ID NO: 437 - DNA, 87 bp, Solanum lycopersicum
  misc_feature: exon 4
aaggttctatggacaccatctaaagtcattgctcgtctgggtaaagaaattaatgatgaaacctcatacttgtattgggcttacaag

SEQ ID NO: 438 - DNA, 1877 bp, Solanum lycopersicum
  misc_feature: intron 4
gtacatttctaatcacttccctttcattacatatttgatgaaattgtaatactcaagttagaatgccaaatctgtcccacatatataatagttacctctccgccgtttcattttgtaaggtgcttttcaaatcacttcccttccgttccatatttgatgaaattaaattggtgaagttagaatgccaaatgatctagctagtcccacatatataattaattattagttacgacttcccctttccattttattggcatagtttgattggacatgaagtttataactgtaaagaatactgttgaatcttgtgtcataaactaaattttgtatatcatgccaaaaatatccgttgaatcttgtgctcttaaatatgtcatgtcatttatgtaagtgagtggggagtgttattaagggtatgttgaagttaaaaacttactaaatatagaaagagacattctttttagacaaactaaaacgagaaggcacataaattgaaatggagggagtaatattgggatgatattttgataaatgagaaagtaagagatatttacctgggagaaaatggatttgcatgcattgtggtagcaaattcatcgttattgagatcagaaagtgaaatcaagagggaaggataaaaggagaagaaaccttcattttttattttttttgaaataatgaggattcatctagctgaccccatcccgtttgtgactgaggcgtagctgttattttcctatattttttttgtttagacgccatagaaccccttaaactatttcctttgaattcaagaaagaaaaagaagtacaacattatatagaaggaaaaagaaagtttaaaaaaggatggatacaacttcagaattctggcagatttttgcaatacttaatttggaggatatcttttgtgcagaaaacatcaataacagttttttctcttatcagatcctttctgcttgccaaatgcacaaaacttcaggaaagtagcttctatcattattcccaggttttccttgcaattaagtagtacctttgtcattctaggtactaaacgttgttatagttttcgtctttcaggtgggaataatagggatagggttgaggatatcttccggaacacctagctgttgttttctggaaaatattgacttttacctagcaaactttacattagtactcaatagggaagaacagaataggataggtctctttccaaagggggggggggtatgaattgaaacacaataccttattttttggatggaaaattaagtcatcctagttaatcttattattattattttggtttttggactcggctgatgttgtaaatagttcagcaatctatcttagtgctgttttgacaaactgaaaatcctattaccttctcaaaaataaaaaggatgtagaaatacctgttttatctctagatattccaagtgaagttttttcacaagcagaaatattttgaatttctaatagaataaatcttgtttccatgaagtttctaaagtttgcccctacaactttatttttttctttcaatccggaatttgctgtagttgcacgttggggtgtgataccagaatactagacaatgggatgaactaaggcatgatctcactattatccattccactatactgatttaaagcccagcgattgacatattatgataatttttggatgatcagaattcagaggttcatcgtggaaattttttgaatttttacttgggcagtttctcgggaagtcatattcactctattatgaagaagggatgatttcatgctttttcagcccagaaaataaaaggaaaacatgcattctcttttagttcatatattaatgttactctcgtatttatcatctcag

SEQ ID NO: 439 - DNA, 133 bp, Solanum lycopersicum
  misc_feature: exon 5
aaccggattcctgtcttctgtcctggcttgacggatggatcacttggtgacatgctatacttccattctttcaaaaagggtgatccagataatccagatcttaatcctggtctagtcatagacattgtaggag

SEQ ID NO: 440 - DNA, 85 bp, Solanum lycopersicum
  misc_feature: intron 5
gtatgagtatcttatcaagtgattctttcctctcatcaagaatttgtttgatgaaagagctaacatgattaagttatataaccag

SEQ ID NO: 441 - DNA, 236 bp, Solanum lycopersicum
  misc_feature: exon 6
atattagggccatgaatggtgaagctgtccatgctggtttgaggaagacaggaatgattatactgggtggagggctgcctaagcaccatgtttgcaatgccaatatgatgcgcaatggtgcagattttgccgtcttcattaacaccgcacaagagtttgatggtagtgactctggtgcccgtcctgatgaagctgtatcatggggaaagatacgtggtggtgccaagactgtgaag

SEQ ID NO: 442 - DNA, 89 bp, Solanum lycopersicum
  misc_feature: intron 6
gttaacaacttacctctaatacattttgtgcaagcatctcctttgtgagattctaatttgttgtagtgtttttgatttgttgaatgcag

SEQ ID NO: 443 - DNA, 483 bp, Solanum lycopersicum
  misc_feature: exon 7
gtgcattgtgatgcaaccattgcatttcccatattagtagctgagacatttgcagctaagagtaaggaattctcccagataaggtgccaagtttgaacattgaggaagctgtccttccgaccacacatatgaattgctagcttttgaagccaacttgctagtgtgcagcaccatttattctgcaaaactgactagagagcagggtatattcctctaccccgagttagacgacatcctgtatggttcaaattaattatttttctccccttcacaccatgttatttagttctcttcctcttcgaaagtgaagagcttagatgttcataggttttgaattatgttggaggttggtgataactgactagtcctcttaccatatagataatgtatccttgtactatgagattttgggtgtgtttgataccaaggaaaaatgtttatttggaaaacaattggatttttaatttattttttcttgtttaa

SEQ ID NO: 444 - DNA, 5996 bp, Solanum tuberosum
gcggcagtggtgttccgtacataatcttcgtctgcaataatgggtgaggctctgaaggacaatatcatggactcagtaagatcggtagttttcaaagaatccgaaaatctagaaggctcttgcacaaaaatcgagggctacgacttcaataaaggcgttaactatgctgagcttatcaagtccatggtttccactggtttccaagcttcaaatcttggtgacgccattgaaattgttaatcaaatggtcagatttcacttctttctttaacttacgctaaaaaagtttgttgctttatgcaaattctcattttttttccagttaacttagatccgatgatattgaattttttcacccatccgcatataataaagttaattgctttacactaactatatttgggtttcaactactctccccttcccattttataagactggaaacagagtttaagatgttagcttgacttatatattagtatgtcattcattagtcatagtggaaaaaaggtcttggtagaaaaattagttccgtagagaaaatatcacattgaagttttaatatgttgtaattaatttggattctaaaagatcatgaaacatgtagatactgaataatatcagtcatgagtatccaggtggtaaacttggcccttggaagcagatttggaggaacaaggtgccaaccaaggtaaagtgtttctcctggttggttgccagaagagcatgctccactcatgagaaattgaaaaggaggggtttctatattgcttcttggtgctctctctgtaatgagactgaggaaaccaacaacccatttgttcctccattgcaaagtgacaacacaattgtggaacctttttttgggactaacacatacataatggattatgcctgagcatacagcagatctacttagttgctggatcagcagaggggggagaaaatctaagaaaaagtggtggagtataataccatcatgcatttggtggtgtattttttttttttgataactgagaaatccgtctgtgacccgccctttggaccaatcacagccttctaaactcggtggataatgggcccgcccctctacccttctccacttaaataccgggtttcgctttgcatggtatggggcttgaacctgcgacctaagccacaaatcctccaccttttgccacttgagctaggccttgggggcgcatttggtggtgtatttggaaagaaagaaataggagatgctatgataacaaagctaattcaatagagaaagtcaaatggaactgcttgactactttttatttttggtgtaaagaggaagggatagaagaagctgcacaaattttggattttataggcactttgtaatctatttgccttttttgttttttctcttgttgaaaaccaatttttggaggtctccagcatatccttaatgctgatgaatacaacattatctttattaaaaaaattaaatatcagtcatgttttggaagtcataaaatatagaaagtagcagtagaaagaagaaagttaaaaatttagagtttgtaggcaaaatatgttaaaagaattattcctaaaatagaaagaatgctatttaagttggaattgggtgggtgtagatagtatgattcatggttcttgtatgcatattggaagtatcgaagacttatttcaattcaattaatatatgaatttacttcggaaaatctgtccaccctcacaagtcaaacctcaccattctttttacagttgatgatgtgcttcttaaaaaatggtttgattttttattaacaggttaccttctttcatacacttgaagtttttgaactagttttaaagttcttaaattgattctagaagtttgaaatttgtgtttttgtttgggggtgtgatggttttgaagctagattggaggctttcacatgagctgctcatggaggattgcagcgaagaagaaagagatgttgcatacagagagtcggtaacctgcaaaatctttttggggttcacttcaaaccttgtttcttctggtgttagagacactgtccgctaccttgttcagcaccgaatggtgagtagcatttaagtaacagttccagtcgtttctgttctactaacttttaagtctgactgtgttgtaccattaagtttgaaccttgtgggctactttcatatgagatcatcttaatatatattctcaatttttttttatgtcccctcccttctacactctaaagctatagttaccacactaatactatggcatccacttattcaacctcaatactcttttatatgatttattatgtcaagcactgaatcactgttatgcttggtttgtattaattgaagattatttatcatgttccactctctccttgtctctctaatttattggttaagcaaactagaatacctcatccttctctctgccacacaagtactaaatgctatggtagaaaattacaatctctgtgtcttaggttttagctgtcatggctagcattggtctaatgaaattgttgttaccatagggaagaattttatattatttattgtgtcttggaccttagcaaattgacttccctccctgcaggttgatgttgtggttactacagctggtggtattgaagaggatctcataaagtgccttgcaccaacctacaagggggatttctctttatctggagctgctctacgatcgaaaggattgaaccgtattggtaacttattggttcctaatgacaactactgcaaatttgagaattggatcatcccaatttttgatcaaatgtatgaggagcagattaatgaggtatctactcttgtctggttcggtgttagatcctcccattacttgtttaatattggctgaagctttaacattcaatcggtattttggaattactttcaaatacaaatggattttttacttgggtcattgtgtttgtgatattctttcaaaaatgataatacttatcttagcttaggcttgtgatgatttgaccgttttatcttctttttgtactacagaaggttctatggacaccatctaaagtcattgctcgcctgggtaaagaaattaatgatgaaacctcatacttgtattgggcttacaaggtacatttctaatcacttccctttcattacatatttgatgaaattgtattactcaagttagaacgccaaatctggtcccacatatataatagttacctctccctcttttcattttataaggtgcatttctaatcacttcccttccattccatatttgatgaaattatattggtgaagttagaatgccaaatgatctagtcccacaatataattaattattaaatacgacttcccctttccattttattggcatagtttgactggacacgaagtttatgaatgtaaagaatacttttgaatcttgtgtcataaactaaagtttgtatatcatgccaaaaatacctgttgtatcttgtggtctactggtcttaaacatgtcatgtcatttatgtaagggagtgttattaagggtatgttgaagttaaaaacttgctaaatatagaaagagacattctttttagacaaactaaaacgagaagtaaggcacataaattgaaatggtgggaataatattgggatattattttgataaatgagaaagtaagagatgttacctgagagaaaatggatttgcatgcatcgtggtagcaaattcatcattattgagatcagcaagtgaaatcaagaggaaaggataaaaggagaagaaacctttttttttttttttggaatgaggaggattcatctagcggaccccatcctgtttgtgactgaggcgtagctgttgtttccctattttttttttgtttagacgccgaaaaaacccttgaactgtttcctttgaattcaagaaagaaaatgaaatacaacattgtataggagggaaaaaagaaagtttaaaagagggatacaacttcagaggcagatttttgcaatacttaattggaggatatcttttgtgcagaaaacatcattaacagtttttactcttatcaaatcctttctgcttgccaaatgcacaaaaattcaggaaagtagcttctatcattattcccaggttttccttgcaattaaatagtacctttgtcattcaaggtactaacctttgttatagttttcgtctttcaggtgggaataatagggattgggttggggatatcttccgaaacacctagctgtcgttttctggaaaatatcgacttttacccaggaaacttttacattagtgcagtagggaagaacagaataggagatgtctctttccaaaggggggtatgaattgaaacaacaccttattttttggtaggaaaattagtgatcctagttaatctcagtttttttttggtttttggacttggctgacgttgctgtaaatagttcaacaatctatcttagtgctgttttgacagactgaaaatccttttaccttctcaaaaataaaaaggttgttaaaatacctgttttatctctagatattccaagtgaagttttttcacaagcagaagtctgcctgctgaaatattgtgacttaatttctaatagaataaatctcgttttcattctcagaaccggattcctgtcttctgtcctggcttgacggatggatcacttggtgacatgctatacttccattctttcaaaaagggagatccagatcttaatcctggtctagtcatagacgttgttggaggtataagtatcttatcaagtgattattttctcttatcaagaatttgtttgatgaaagaactaacataattaagttctataaccagatattagggccatgaatggtgaagctgtccatgctggtttgaggaagacaggaatgattatactgggtggagggctgcctaagcaccatatttgcaatgccaatatgatgcgcaatggtgcagattttgccgtcttcattaacactgcacaagagtttgatggtagtgactctggtgcccgtcctgatgaagctgtatcatggggaaagatacgtggtggcgccaagactgtgaaggttaacaacttacctcttctacattttgtgcaagcatctcctttgggtgtgttgttatcatgaagattaaatggaggggaaaaggtctgtctggcaggtttgtgatgggaaaaaagatttgtcatgagttaagaggaggtgatgtttcattatttaaaaatctcaaagagttaatatcactaagtttagctcgaggagggaagttcaaatgtgtcaaaagcttatgagagagtatacactttgctcaaccttacgaatagtttatttagttaaatttttttatgttttcctatctgggttaaaattagggcaacagaaatcatttctagaacaaggttggttcttttactgtccctgctatatatttatcagactataggcttcaaaggatgtgagattctaatttgttgtactgtttttgatttgttgaatgcaggtgcattgtgatgcaacaattgcatttcccatattagtagctgagacatttgcagccaagagtaaggaattctcccagataaggtgccaagtttgaacatagaggaagctgtccttccaaccacacatatgaattgctagcttttgaagccaacttgctagtgtgcagcatcatttattctgcaagactgactagagagcagggtatattcctgtaccccgagttagacgacatcctgtatggttcaaattaattatttttctccccttcacaccatgttatttagttctcttcctcttctaaagtgaagagcttagatgttcataggttttgaatcatgttgtatcatattttgagttttggaggttggtgataactgacaagtcctcttaccatatatatgatggatccttgtactatgagatttagggtgtgtttggtacgaaggaaaatggtttttggaaacaagtggattttaaattta

SEQ ID NO: 445 - DNA, 246 bp, Solanum tuberosum
  misc_feature: exon 1
gcggcagtggtgttccgtacataatcttcgtctgcaataatgggtgaggctctgaaggacaatatcatggactcagtaagatcggtagttttcaaagaatccgaaaatctagaaggctcttgcacaaaaatcgagggctacgacttcaataaaggcgttaactatgctgagcttatcaagtccatggtttccactggtttccaagcttcaaatcttggtgacgccattgaaattgttaatcaaatg

SEQ ID NO: 446 - DNA, 1662 bp, Solanum tuberosum
  misc_feature: intron 1
gtcagatttcacttctttctttaacttacgctaaaaaagtttgttgctttatgcaaattctcattttttttccagttaacttagatccgatgatattgaattttttcacccatccgcatataataaagttaattgctttacactaactatatttgggtttcaactactctccccttcccattttataagactggaaacagagtttaagatgttagcttgacttatatattagtatgtcattcattagtcatagtggaaaaaaggtcttggtagaaaaattagttccgtagagaaaatatcacattgaagttttaatatgttgtaattaatttggattctaaaagatcatgaaacatgtagatactgaataatatcagtcatgagtatccaggtggtaaacttggcccttggaagcagatttggaggaacaaggtgccaaccaaggtaaagtgtttctcctggttggttgccagaagagcatgctccactcatgagaaattgaaaaggaggggtttctatattgcttcttggtgctctctctgtaatgagactgaggaaaccaacaacccatttgttcctccattgcaaagtgacaacacaattgtggaacctttttttgggactaacacatacataatggattatgcctgagcatacagcagatctacttagttgctggatcagcagaggggggagaaaatctaagaaaaagtggtggagtataataccatcatgcatttggtggtgtattttttttttttgataactgagaaatccgtctgtgacccgccctttggaccaatcacagccttctaaactcggtggataatgggcccgcccctctacccttctccacttaaataccgggtttcgctttgcatggtatggggcttgaacctgcgacctaagccacaaatcctccaccttttgccacttgagctaggccttgggggcgcatttggtggtgtatttggaaagaaagaaataggagatgctatgataacaaagctaattcaatagagaaagtcaaatggaactgcttgactactttttatttttggtgtaaagaggaagggatagaagaagctgcacaaattttggattttataggcactttgtaatctatttgccttttttgttttttctcttgttgaaaaccaatttttggaggtctccagcatatccttaatgctgatgaatacaacattatctttattaaaaaaattaaatatcagtcatgttttggaagtcataaaatatagaaagtagcagtagaaagaagaaagttaaaaatttagagtttgtaggcaaaatatgttaaaagaattattcctaaaatagaaagaatgctatttaagttggaattgggtgggtgtagatagtatgattcatggttcttgtatgcatattggaagtatcgaagacttatttcaattcaattaatatatgaatttacttcggaaaatctgtccaccctcacaagtcaaacctcaccattctttttacagttgatgatgtgcttcttaaaaaatggtttgattttttattaacaggttaccttctttcatacacttgaagtttttgaactagttttaaagttcttaaattgattctagaagtttgaaatttgtgtttttgtttgggggtgtgatggttttgaag

SEQ ID NO: 447 - DNA, 168 bp, Solanum tuberosum
  misc_feature: exon 2
ctagattggaggctttcacatgagctgctcatggaggattgcagcgaagaagaaagagatgttgcatacagagagtcggtaacctgcaaaatctttttggggttcacttcaaaccttgtttcttctggtgttagagacactgtccgctaccttgttcagcaccgaatg

SEQ ID NO: 448 - DNA, 525 bp, Solanum tuberosum
  misc_feature: intron 2
gtgagtagcatttaagtaacagttccagtcgtttctgttctactaacttttaagtctgactgtgttgtaccattaagtttgaaccttgtgggctactttcatatgagatcatcttaatatatattctcaatttttttttatgtcccctcccttctacactctaaagctatagttaccacactaatactatggcatccacttattcaacctcaatactcttttatatgatttattatgtcaagcactgaatcactgttatgcttggtttgtattaattgaagattatttatcatgttccactctctccttgtctctctaatttattggttaagcaaactagaatacctcatccttctctctgccacacaagtactaaatgctatggtagaaaattacaatctctgtgtcttaggttttagctgtcatggctagcattggtctaatgaaattgttgttaccatagggaagaattttatattatttattgtgtcttggaccttagcaaattgacttccctccctgcag

SEQ ID NO: 449 - DNA, 219 bp, Solanum tuberosum
  misc_feature: exon 3
gttgatgttgtggttactacagctggtggtattgaagaggatctcataaagtgccttgcaccaacctacaagggggatttctctttatctggagctgctctacgatcgaaaggattgaaccgtattggtaacttattggttcctaatgacaactactgcaaatttgagaattggatcatcccaatttttgatcaaatgtatgaggagcagattaatgag

SEQ ID NO: 450 - DNA, 218 bp, Artificial Sequence
  Synthetic (Solanum tuberosum intron 3)
  misc_feature: intron 3
gtatctactcttgtctggttcggtgttagatcctcccattacttgtttaatattggctgaagctttaacattcaatcggtattttggaattactttcaaatacaaatggattttttacttgggtcattgtgtttgtgatattctttcaaaaatgataatacttatcttagcttaggcttgtgatgatttgaccgttttatcttctttttgtactacag

SEQ ID NO: 451 - DNA, 87 bp, Solanum tuberosum
  misc_feature: exon 4
aaggttctatggacaccatctaaagtcattgctcgcctgggtaaagaaattaatgatgaaacctcatacttgtattgggcttacaag

SEQ ID NO: 452 - DNA, 1506 bp, Solanum tuberosum
  misc_feature: intron 4
gtacatttctaatcacttccctttcattacatatttgatgaaattgtattactcaagttagaacgccaaatctggtcccacatatataatagttacctctccctcttttcattttataaggtgcatttctaatcacttcccttccattccatatttgatgaaattatattggtgaagttagaatgccaaatgatctagtcccacaatataattaattattaaatacgacttcccctttccattttattggcatagtttgactggacacgaagtttatgaatgtaaagaatacttttgaatcttgtgtcataaactaaagtttgtatatcatgccaaaaatacctgttgtatcttgtggtctactggtcttaaacatgtcatgtcatttatgtaagggagtgttattaagggtatgttgaagttaaaaacttgctaaatatagaaagagacattctttttagacaaactaaaacgagaagtaaggcacataaattgaaatggtgggaataatattgggatattattttgataaatgagaaagtaagagatgttacctgagagaaaatggatttgcatgcatcgtggtagcaaattcatcattattgagatcagcaagtgaaatcaagaggaaaggataaaaggagaagaaacctttttttttttttttggaatgaggaggattcatctagcggaccccatcctgtttgtgactgaggcgtagctgttgtttccctattttttttttgtttagacgccgaaaaaacccttgaactgtttcctttgaattcaagaaagaaaatgaaatacaacattgtataggagggaaaaaagaaagtttaaaagagggatacaacttcagaggcagatttttgcaatacttaattggaggatatcttttgtgcagaaaacatcattaacagtttttactcttatcaaatcctttctgcttgccaaatgcacaaaaattcaggaaagtagcttctatcattattcccaggttttccttgcaattaaatagtacctttgtcattcaaggtactaacctttgttatagttttcgtctttcaggtgggaataatagggattgggttggggatatcttccgaaacacctagctgtcgttttctggaaaatatcgacttttacccaggaaacttttacattagtgcagtagggaagaacagaataggagatgtctctttccaaaggggggtatgaattgaaacaacaccttattttttggtaggaaaattagtgatcctagttaatctcagtttttttttggtttttggacttggctgacgttgctgtaaatagttcaacaatctatcttagtgctgttttgacagactgaaaatccttttaccttctcaaaaataaaaaggttgttaaaatacctgttttatctctagatattccaagtgaagttttttcacaagcagaagtctgcctgctgaaatattgtgacttaatttctaatagaataaatctcgttttcattctcag

SEQ ID NO: 453 - DNA, 124 bp, Solanum tuberosum
  misc_feature: exon 5
aaccggattcctgtcttctgtcctggcttgacggatggatcacttggtgacatgctatacttccattctttcaaaaagggagatccagatcttaatcctggtctagtcatagacgttgttggag

SEQ ID NO: 454 - DNA, 85 bp, Solanum tuberosum
  misc_feature: intron 5
gtataagtatcttatcaagtgattattttctcttatcaagaatttgtttgatgaaagaactaacataattaagttctataaccag

SEQ ID NO: 455 - DNA, 236 bp, Solanum tuberosum
  misc_feature: exon 6
atattagggccatgaatggtgaagctgtccatgctggtttgaggaagacaggaatgattatactgggtggagggctgcctaagcaccatatttgcaatgccaatatgatgcgcaatggtgcagattttgccgtcttcattaacactgcacaagagtttgatggtagtgactctggtgcccgtcctgatgaagctgtatcatggggaaagatacgtggtggcgccaagactgtgaag

SEQ ID NO: 456 - DNA, 436 bp, Solanum tuberosum
  misc_feature: intron 6
gttaacaacttacctcttctacattttgtgcaagcatctcctttgggtgtgttgttatcatgaagattaaatggaggggaaaaggtctgtctggcaggtttgtgatgggaaaaaagatttgtcatgagttaagaggaggtgatgtttcattatttaaaaatctcaaagagttaatatcactaagtttagctcgaggagggaagttcaaatgtgtcaaaagcttatgagagagtatacactttgctcaaccttacgaatagtttatttagttaaatttttttatgttttcctatctgggttaaaattagggcaacagaaatcatttctagaacaaggttggttcttttactgtccctgctatatatttatcagactataggcttcaaaggatgtgagattctaatttgttgtactgtttttgatttgttgaatgcag

SEQ ID NO: 457 - DNA, 484 bp, Solanum tuberosum
  misc_feature: exon 7
gtgcattgtgatgcaacaattgcatttcccatattagtagctgagacatttgcagccaagagtaaggaattctcccagataaggtgccaagtttgaacatagaggaagctgtccttccaaccacacatatgaattgctagcttttgaagccaacttgctagtgtgcagcatcatttattctgcaagactgactagagagcagggtatattcctgtaccccgagttagacgacatcctgtatggttcaaattaattatttttctccccttcacaccatgttatttagttctcttcctcttctaaagtgaagagcttagatgttcataggttttgaatcatgttgtatcatattttgagttttggaggttggtgataactgacaagtcctcttaccatatatatgatggatccttgtactatgagatttagggtgtgtttggtacgaaggaaaatggtttttggaaacaagtggattttaaattta

SEQ ID NO: 458 - DNA, 3770 bp, Triticum aestivum
gcggaggaggctcgtgctccaggtcagtggttcgccggagatggccggcgagggcggaagcggcggagagcgcagcaaggacccgctggagggcgtccgcgccatcgtgctcaagccgtccgagtccctcgacgagtcgcggttcaccaaaatcgccggcgccgacttcaacgacgccggcctcggcctcgacggcctccttgggtcgctcgcctccacggggttccaggcgtccaacctcggcgacgccatcgacgtcgtcaatcagatggtacggcacaccgcccgctttccccttcctccatcagctgcgagctttgcccttttcagcatgggattagttcccagaaccaggcgaagcagatactccagcatgggagtgattcattccgtttatttcgccatttggagcacttggatagcctgcatatatatcgtttcgatgccagggtgaagctgatgagtgtttttcccccaaagtaaatctgttagatgcatctgaacagtctagctgaatgtgtgtgcgtctcttgtttaatccaagtgctttgcgttaaattatctggaggtgatctgtatgaaggaatgcctgtcatatcactatgcatgcttccagaatttctgccgattttcgccactccttacattctactgactctttctccactgtaatttgctgcaatgaagttagattggaggctgtcgcatgagaagccaagcgaggactgtgatgaagctgaacttgacccgaaatacagagaatctgtcaagtgcaagatattccttggtttcacttcgaaccttgtttcttccggtatacgggatgtaatacggtttctagttcaacatcacatggtaaatgctccaactctgtgtcacgtgtgcaaatctgaaagcaaagcaactttaaatatcatcttaagaatctgtgtattagaagtatgcctagttgcctagagatgtttgttccagttaatccactaactgcatagccattgatttcccaatccatgctaattattttccacaaaattcttcaggtggatgttgttgtaacgacagctgggggtatagaggaagacctcataaaatgcctagcaccaacgtaccgaggtgaattttctttacctggggcactgctacggtcaaaaggacttaaccggataggaaatctgttggtgcccaatgataactattgcaagtttgaaaactggatcatgccactctttgaccagatgctacaagaacaatctaccgaggtaatgattcctcttggcttaaacacagctggtaataatctgtttcaattctcgtcccttgtgtccctagttaccgaaatcccccattaatgtggattatggctacccttccttgtatgtgtcatgtgcccattatagtgcacatggtagcttctgatgcataaattagctgcaaagttggtaatttgcaggggatgcatgaataggagagtacattaattatatcttgtatttagcgacactagtagtaatataattttgatagggttgtcttctagtctttgaaaatttccttaattgaagggtacacaattacttttctggaacagcaaataagcaggaaaggaaaataaaataaaaatgaagagaacttaaatctggctcaaagtacttacaagttacagtacaacagtatttgtttcacatgctatagtaaggatgcttaaaacaactgaaattctacgtaacatgaagtcacggactttattgtaacctggctccatgagtttcctttctttcagatgtatgcatctagcaatatatacacgaataaacatccagactacaggatcttgtcaaacctaatgtgcgaagtacactttataagtttctgcacgaattgctgaagtctacgcagatattgttgcaccttggttgatacttgatcttttaattaaagataatccagcatttcctacaatgtgaattctttgtacaagcttcactgctgaccatacttatgtttcttttaatttcttgttacctacagaatgtctggacaccatcaaaggtgattgctcgtcttggcaaagaaataaatgatgaaagctcctacctttattgggcatacaaggtaccatgcttttgacagttctttgtaatttttagaaattatcagaaagtctgcaggcatgtgtttgttgtgtaaatgctgatcatatttaagaagtctgtaaataactatgtttggtaaacagggagataaagtaggttttcttcttaagaatttttttgagtttgattctcttattggtgctgttttaccataaaaaaatcttaaccgtatcgagtcttatgattttacccagaaatagtaatcattcctgaaccaaacttttgttttgtctgaagtggctggtcacagtttagcagatgtaagcatggtagagttgctggctggctgttacacttattgggttgtccttcactgtattgcatggagaatatgcttcatactgggttgttttttctgggttgaaattcttaactttcaagaactatttgttcaaagactgaagttgcaaagtgctgactcgttaaaatcgaccagaacaatattcctgtatactgcccagcattgactgatggatcactcggagacatgctgttttgtcatgcagttcgcaatcctggtcttattatcgacattgtacaaggtaagttccactttatttgatatccttactttgtgttcgttttcaaatgcttgaacatttttgcagatataaggctgataaatggtgaagccattcatgcaagcccaaggaagacaggggtcataattcttggtggaggccttccaaagcatcatatatgcaatgcaaatatgttccgcaatggtgcagattatgcagtctatatcaacacggctcaagagtttgatggaagtgactcaggagcacggccagatgaagcagtttcatggggaaagatcaaaggttcagcaaaacctgtaaaggtacatatatagatcttcacaagttcagagatgtttttgttttgcgttttgcatactagtgggctctgttggtgaaaagttccttaggtataaggtataatgaccatgatgcatctgctcatgtatcttgcaatggtttatagaaaatttcatccatgatcctgaactgggttataatatttagaccatcttgatttatcatgatcctgaactgggttataatatttagaccataatcactttcccatgtacaacttttacactgtagaatagtattgcagcctatgagtttatgtcactatgagtgattttaagagacataattgtgctgtgcaatggtgtcatacatcatatttgatgattgttatcattgcaatctaacatttcagctcttggaatccaggtccactgtgatgcaactatcgctttcccgttacttgtagctgcaacatttgcacgtaggtctcatggtgcaaattcaaccaactgaatttctggcagcgaactaagggcctcaaattgattttttattgatctccaattgtttgtctggactctttggaggataacatggaaggttttttgtcagatgccgaccacagttactgattccttttgtttgatgtacacctgaggttgtaataccaattgtatgctttgtaatgagattatgtatggagtgccaacatattaggaaatattatgaaacggacggttgttccaatatttatctgactctggaaaactgtgactttataaagaaattatctggt

SEQ ID NO: 459 - DNA, 271 bp, Triticum aestivum
  misc_feature: exon 1
gcggaggaggctcgtgctccaggtcagtggttcgccggagatggccggcgagggcggaagcggcggagagcgcagcaaggacccgctggagggcgtccgcgccatcgtgctcaagccgtccgagtccctcgacgagtcgcggttcaccaaaatcgccggcgccgacttcaacgacgccggcctcggcctcgacggcctccttgggtcgctcgcctccacggggttccaggcgtccaacctcggcgacgccatcgacgtcgtcaatcagatg

SEQ ID NO: 460 - DNA, 416 bp, Triticum aestivum
  misc_feature: intron 1
gtacggcacaccgcccgctttccccttcctccatcagctgcgagctttgcccttttcagcatgggattagttcccagaaccaggcgaagcagatactccagcatgggagtgattcattccgtttatttcgccatttggagcacttggatagcctgcatatatatcgtttcgatgccagggtgaagctgatgagtgtttttcccccaaagtaaatctgttagatgcatctgaacagtctagctgaatgtgtgtgcgtctcttgtttaatccaagtgctttgcgttaaattatctggaggtgatctgtatgaaggaatgcctgtcatatcactatgcatgcttccagaatttctgccgattttcgccactccttacattctactgactctttctccactgtaatttgctgcaatgaag

SEQ ID NO: 461 - DNA, 168 bp, Triticum aestivum
  misc_feature: exon 2
ttagattggaggctgtcgcatgagaagccaagcgaggactgtgatgaagctgaacttgacccgaaatacagagaatctgtcaagtgcaagatattccttggtttcacttcgaaccttgtttcttccggtatacgggatgtaatacggtttctagttcaacatcacatg

SEQ ID NO: 462 - DNA, 185 bp, Triticum aestivum
  misc_feature: intron 2
gtaaatgctccaactctgtgtcacgtgtgcaaatctgaaagcaaagcaactttaaatatcatcttaagaatctgtgtattagaagtatgcctagttgcctagagatgtttgttccagttaatccactaactgcatagccattgatttcccaatccatgctaattattttccacaaaattcttcag

SEQ ID NO: 463 - DNA, 215 bp, Triticum aestivum
  misc_feature: exon 3
gtggatgttgttgtaacgacagctgggggtatagaggaagacctcataaaatgcctagcaccaacgtaccgaggtgaattttctttacctggggcactgctacggtcaaaaggacttaaccggataggaaatctgttggtgcccaatgataactattgcaagtttgaaaactggatcatgccactctttgaccagatgctacaagaacaatctac

SEQ ID NO: 464 - DNA, 771 bp, Triticum aestivum
  misc_feature: intron 3
cgaggtaatgattcctcttggcttaaacacagctggtaataatctgtttcaattctcgtcccttgtgtccctagttaccgaaatcccccattaatgtggattatggctacccttccttgtatgtgtcatgtgcccattatagtgcacatggtagcttctgatgcataaattagctgcaaagttggtaatttgcaggggatgcatgaataggagagtacattaattatatcttgtatttagcgacactagtagtaatataattttgatagggttgtcttctagtctttgaaaatttccttaattgaagggtacacaattacttttctggaacagcaaataagcaggaaaggaaaataaaataaaaatgaagagaacttaaatctggctcaaagtacttacaagttacagtacaacagtatttgtttcacatgctatagtaaggatgcttaaaacaactgaaattctacgtaacatgaagtcacggactttattgtaacctggctccatgagtttcctttctttcagatgtatgcatctagcaatatatacacgaataaacatccagactacaggatcttgtcaaacctaatgtgcgaagtacactttataagtttctgcacgaattgctgaagtctacgcagatattgttgcaccttggttgatacttgatcttttaattaaagataatccagcatttcctacaatgtgaattctttgtacaagcttcactgctgaccatacttatgtttcttttaatttcttgttacctac

SEQ ID NO: 465 - DNA, 86 bp, Triticum aestivum
  misc_feature: exon 4
agaatgtctggacaccatcaaaggtgattgctcgtcttggcaaagaaataaatgatgaaagctcctacctttattgggcatacaag

SEQ ID NO: 466 - DNA, 477 bp, Triticum aestivum
  misc_feature: intron 4
gtaccatgcttttgacagttctttgtaatttttagaaattatcagaaagtctgcaggcatgtgtttgttgtgtaaatgctgatcatatttaagaagtctgtaaataactatgtttggtaaacagggagataaagtaggttttcttcttaagaatttttttgagtttgattctcttattggtgctgttttaccataaaaaaatcttaaccgtatcgagtcttatgattttacccagaaatagtaatcattcctgaaccaaacttttgttttgtctgaagtggctggtcacagtttagcagatgtaagcatggtagagttgctggctggctgttacacttattgggttgtccttcactgtattgcatggagaatatgcttcatactgggttgttttttctgggttgaaattcttaactttcaagaactatttgttcaaagactgaagttgcaaagtgctgactcgttaaaatcgaccag

SEQ ID NO: 467 - DNA, 106 bp, Triticum aestivum
  misc_feature: exon 5
aacaatattcctgtatactgcccagcattgactgatggatcactcggagacatgctgttttgtcatgcagttcgcaatcctggtcttattatcgacattgtacaag

SEQ ID NO: 468 - DNA, 66 bp, Triticum aestivum
  misc_feature: intron 5
gtaagttccactttatttgatatccttactttgtgttcgttttcaaatgcttgaacatttttgcag

SEQ ID NO: 469 - DNA, 236 bp, Triticum aestivum
  misc_feature: exon 6
atataaggctgataaatggtgaagccattcatgcaagcccaaggaagacaggggtcataattcttggtggaggccttccaaagcatcatatatgcaatgcaaatatgttccgcaatggtgcagattatgcagtctatatcaacacggctcaagagtttgatggaagtgactcaggagcacggccagatgaagcagtttcatggggaaagatcaaaggttcagcaaaacctgtaaag

SEQ ID NO: 470 - DNA, 403 bp, Triticum aestivum
  misc_feature: intron 6
gtacatatatagatcttcacaagttcagagatgtttttgttttgcgttttgcatactagtgggctctgttggtgaaaagttccttaggtataaggtataatgaccatgatgcatctgctcatgtatcttgcaatggtttatagaaaatttcatccatgatcctgaactgggttataatatttagaccatcttgatttatcatgatcctgaactgggttataatatttagaccataatcactttcccatgtacaacttttacactgtagaatagtattgcagcctatgagtttatgtcactatgagtgattttaagagacataattgtgctgtgcaatggtgtcatacatcatatttgatgattgttatcattgcaatctaacatttcagctcttggaatccag

SEQ ID NO: 471 - DNA, 175 bp, Triticum aestivum
  misc_feature: exon 7
gtccactgtgatgcaactatcgctttcccgttacttgtagctgcaacatttgcacgtaggtctcatggtgcaaattcaaccaactgaatttctggcagcgaactaagggcctcaaattgattttttattgatctccaattgtttgtctggactctttggaggataacatggaagg

SEQ ID NO: 472 - DNA, 194 bp, Triticum aestivum
  misc_feature: exon 8
tttttgtcagatgccgaccacagttactgattccttttgtttgatgtacacctgaggttgtaataccaattgtatgctttgtaatgagattatgtatggagtgccaacatattaggaaatattatgaaacggacggttgttccaatatttatctgactctggaaaactgtgactttataaagaaattatctggt

SEQ ID NO: 473 - DNA, 3632 bp, Theobroma cacao
atgtcattggcaaagtcactaattttaagaaaaaaatttgagaataagaaaataagttgaattgaatttttagcctttgaatttggtgtcaaagtttaaacattttcccatgaaaaagaacttagctttccaaatcaataatcaaattaattagcaaaaaaaataaatcccaaattaaaacaagcagcataaaattatcaaatttcaaaattttttgaaaaaataaaacattataatgacctttttgtgcttcttttcccaatttcatttaaataaaagaaaaaagaaacaaggaacataacaagaaagaatcttgccgcaagctgcgtactgtaaaaccctctcaactctccgtcggtctctccacgccgcctaaagaaggctgctttctgtctttcggacccgaagctcttaaacccggtttgactctctcctttttctctctctacgtttcttagaaattactaacaaagctgaagattactgtcttagtctcgctctcggattgctttgtatttgtttcatgaatgctttttgcctgcaaaagaatttgcaaattaactacattctctgtctctgcttaaacttgggttcttcaatttgctgctctgcttgtaccttaattgtctattgaaattactttcaaatttctaagctattttcatccttggttgggattttgatagtgtgatacagggttcactgaaagcagggtttttttttttttatttaatgaagtggtttcatcattttagggtatattgatggatatttgggatgtgaagaataagacttaatgatgctatgcaatcagtatcttgctggttgaaatagcttgatgcaataagcaatctagatatggatatgtgtgggaatgtatcagtaaagtgctcttgccgcttatcgctgcattttaagtaataaagctagtcctttggaggttttttcattttggaagcttaggcttactgcttgaatcagcttttataatgattatcacaaaataatggacataaaaaggaagtaattttaaatggttggcaatgcccaatctctttcatttgttttttttttctttcttatatcagtccaaacaacttaagcttgatgctttattcatgtttattccattgccaggtttcctggccaagaacaaaagaagaaaagggagatatggaggataagctcatgaactctgtacactccaccgtttttaaagagtcagattcccttgaggggaagtgtacaaaaattgagggttatgacttcaatcagggtgtaaactactcccagcttctcaagtccatgctttccactggatttcaagcttccaatcttggagaagctatggaaattgtcaatgagatggttagtttcatttatttagatttctttttcttttttttttttctcatactgttttggatgctgtgtttgtgtttctttttctactacttggttgttgctagcttattctatataaacattttcaatccaattgaagctagactggaggcttgctgatgaggctataactgaggactgcagtgaggaggagaaggatcctgcctacagagaatctgtcagatgcaaggtctttttgggttttacatcaaatcttatttcatctggtcttcgagatactgttcgttatcttactgagcatcacatggtgagttgctaatcaaacctgagaatctgacttcttttgtgtagaattgagatgagatgaaatgaaaaatgtaatgagataaaaagtagtagactgtctacaatcctctgaatcttgcccacagcaggaacctaagaaggagaaaaagaagaaaataagggaaaggaatctgaaatagttaaatgctgtaaataattaaaatcaattttatctttggccttatttttcaaaaggatttcaaatctgtcatcatgttcttgatgtggctctctggtggctctccactccatctaagaagtgttactgttaaactgactgcaggttgatgtaatagttactacaactggtggcatagaagaagatctcataaagtgccttgcaccaacatataaaggtgatttttatctacctggtgctcagttgcgttcaagaggattgaatcgcattggtaacttgttggttcctaatgacaactactgcaaatttgaggattggatcattccaatttttgatcagatgttgaaggaacaacttgaagaggtacttctacacacaaacacttgcagactatgtcataccctcttgtttgtctgacaaatttgacctccaaattgtcacattggatttgggcccttttagttttcactaaatatcgaaaagaagattaattcttggggtctaattttttgtgtattgtcattttttagtaaagaatttgaagattgtagatgaggtcaaatcgaataataatggagcttgtatttgtactctattctattgatttcagttaccattattagatgtatctcttgtgacctagtggtgtctgccattctgttaagttcctcttgcctcttgtttttggttttcacagaatgtattgtggactccatcaaagttaattgcacgcttgggaagagaaataaataatgaaagttcatacctctactgggcatacaaggcaagtgtcctaccaatttagcttaatgctgtgataatataactacttttcccccttttctttttctatgataaaaatggtcagatctacattattgacttttgtgttggtatcaatgaccttctgtaataaatgtcattcatttactataccccattgaggtcatatataatactaataagttagttatagttgtttaatctattatgaagtattgcattattgttgtgaagatattttgttactgcttgactaccttattttatcctttctactacaatgccgtacgatatgagtctcgtcaactaatatcatgagtttatcttgaagaagtgattgaattcatttattactgaagaagacgccactaatgaattctcaagcaactgtaacagtagagaacatgcatttcatatcatgtttctgaagtttcatcatctagattttgtaattttgctctatgcaatgatagtctaggaggacttttaagcataacgttggtaatatttgtttttccccttatggcaccacagcttatttttattatttatgagtattttccagaacgagattcctgtcttctgtccaggcttaacagatggctctttgggggatatgttgtattttcattcctttcacagcccaggtctgataattgatgtagtgcaaggtaggtgttttctgtttcatcttcattacttgcttattactgactgattgaagattgggatataaacatctaatcgtcttacttattgaacagatattagggccatgaatagtgaagcagtccatgcaagtcccaggaaaacaggaatgataattctaggaggtggactgccaaagcatcatatctgcaatgctaatatgatgcgtaatggtgctgattatgctgtttacataaatacagcacaagagtttgatgggagtgattctggagcccgccctgatgaggctatttcatgggggaaaatacgaggttctgctagaacggttaag

SEQ ID NO: 474 - DNA, 590 bp, Theobroma cacao
  misc_feature: exon 1
atgtcattggcaaagtcactaattttaagaaaaaaatttgagaataagaaaataagttgaattgaatttttagcctttgaatttggtgtcaaagtttaaacattttcccatgaaaaagaacttagctttccaaatcaataatcaaattaattagcaaaaaaaataaatcccaaattaaaacaagcagcataaaattatcaaatttcaaaattttttgaaaaaataaaacattataatgacctttttgtgcttcttttcccaatttcatttaaataaaagaaaaaagaaacaaggaacataacaagaaagaatcttgccgcaagctgcgtactgtaaaaccctctcaactctccgtcggtctctccacgccgcctaaagaaggctgctttctgtctttcggacccgaagctcttaaacccggtttgactctctcctttttctctctctacgtttcttagaaattactaacaaagctgaagattactgtcttagtctcgctctcggattgctttgtatttgtttcatgaatgctttttgcctgcaaaagaatttgcaaattaactacattctctgtctctgcttaaacttgg

SEQ ID NO: 475 - DNA, 547 bp, Theobroma cacao
  misc_feature: intron 1
gttcttcaatttgctgctctgcttgtaccttaattgtctattgaaattactttcaaatttctaagctattttcatccttggttgggattttgatagtgtgatacagggttcactgaaagcagggtttttttttttttatttaatgaagtggtttcatcattttagggtatattgatggatatttgggatgtgaagaataagacttaatgatgctatgcaatcagtatcttgctggttgaaatagcttgatgcaataagcaatctagatatggatatgtgtgggaatgtatcagtaaagtgctcttgccgcttatcgctgcattttaagtaataaagctagtcctttggaggttttttcattttggaagcttaggcttactgcttgaatcagcttttataatgattatcacaaaataatggacataaaaaggaagtaattttaaatggttggcaatgcccaatctctttcatttgttttttttttctttcttatatcagtccaaacaacttaagcttgatgctttattcatgtttattccattgccag

SEQ ID NO: 476 - DNA, 231 bp, Theobroma cacao
  misc_feature: exon 2
gtttcctggccaagaacaaaagaagaaaagggagatatggaggataagctcatgaactctgtacactccaccgtttttaaagagtcagattcccttgaggggaagtgtacaaaaattgagggttatgacttcaatcagggtgtaaactactcccagcttctcaagtccatgctttccactggatttcaagcttccaatcttggagaagctatggaaattgtcaatgagatg

SEQ ID NO: 477 - DNA, 136 bp, Theobroma cacao
  misc_feature: intron 2
gttagtttcatttatttagatttctttttcttttttttttttctcatactgttttggatgctgtgtttgtgtttctttttctactacttggttgttgctagcttattctatataaacattttcaatccaattgaag

SEQ ID NO: 478 - DNA, 168 bp, Theobroma cacao
  misc_feature: exon 3
ctagactggaggcttgctgatgaggctataactgaggactgcagtgaggaggagaaggatcctgcctacagagaatctgtcagatgcaaggtctttttgggttttacatcaaatcttatttcatctggtcttcgagatactgttcgttatcttactgagcatcacatg

SEQ ID NO: 479 - DNA, 321 bp, Theobroma cacao
  misc_feature: intron 3
gtgagttgctaatcaaacctgagaatctgacttcttttgtgtagaattgagatgagatgaaatgaaaaatgtaatgagataaaaagtagtagactgtctacaatcctctgaatcttgcccacagcaggaacctaagaaggagaaaaagaagaaaataagggaaaggaatctgaaatagttaaatgctgtaaataattaaaatcaattttatctttggccttatttttcaaaaggatttcaaatctgtcatcatgttcttgatgtggctctctggtggctctccactccatctaagaagtgttactgttaaactgactgcag

SEQ ID NO: 480 - DNA, 219 bp, Theobroma cacao
  misc_feature: exon 4
gttgatgtaatagttactacaactggtggcatagaagaagatctcataaagtgccttgcaccaacatataaaggtgatttttatctacctggtgctcagttgcgttcaagaggattgaatcgcattggtaacttgttggttcctaatgacaactactgcaaatttgaggattggatcattccaatttttgatcagatgttgaaggaacaacttgaagag

SEQ ID NO: 481 - DNA, 985 bp, Theobroma cacao
  misc_feature: intron 4
gtacttctacacacaaacacttgcagactatgtcataccctcttgtttgtctgacaaatttgacctccaaattgtcacattggatttgggcccttttagttttcactaaatatcgaaaagaagattaattcttggggtctaattttttgtgtattgtcattttttagtaaagaatttgaagattgtagatgaggtcaaatcgaataataatggagcttgtatttgtactctattctattgatttcagttaccattattagatgtatctcttgtgacctagtggtgtctgccattctgttaagttcctcttgcctcttgtttttggttttcacagaatgtattgtggactccatcaaagttaattgcacgcttgggaagagaaataaataatgaaagttcatacctctactgggcatacaaggcaagtgtcctaccaatttagcttaatgctgtgataatataactacttttcccccttttctttttctatgataaaaatggtcagatctacattattgacttttgtgttggtatcaatgaccttctgtaataaatgtcattcatttactataccccattgaggtcatatataatactaataagttagttatagttgtttaatctattatgaagtattgcattattgttgtgaagatattttgttactgcttgactaccttattttatcctttctactacaatgccgtacgatatgagtctcgtcaactaatatcatgagtttatcttgaagaagtgattgaattcatttattactgaagaagacgccactaatgaattctcaagcaactgtaacagtagagaacatgcatttcatatcatgtttctgaagtttcatcatctagattttgtaattttgctctatgcaatgatagtctaggaggacttttaagcataacgttggtaatatttgtttttccccttatggcaccacagcttatttttattatttatgagtattttccag

SEQ ID NO: 482 - DNA, 106 bp, Theobroma cacao
  misc_feature: exon 5
aacgagattcctgtcttctgtccaggcttaacagatggctctttgggggatatgttgtattttcattcctttcacagcccaggtctgataattgatgtagtgcaag

SEQ ID NO: 483 - DNA, 93 bp, Theobroma cacao
  misc_feature: intron 5
gtaggtgttttctgtttcatcttcattacttgcttattactgactgattgaagattgggatataaacatctaatcgtcttacttattgaacag

SEQ ID NO: 484 - DNA, 236 bp, Theobroma cacao
  misc_feature: exon 6
atattagggccatgaatagtgaagcagtccatgcaagtcccaggaaaacaggaatgataattctaggaggtggactgccaaagcatcatatctgcaatgctaatatgatgcgtaatggtgctgattatgctgtttacataaatacagcacaagagtttgatgggagtgattctggagcccgccctgatgaggctatttcatgggggaaaatacgaggttctgctagaacggttaag

SEQ ID NO: 485 - DNA, 5502 bp, Vitis vinifera
atggaagagaatttcctatcatctgtacgatcggtagtcttcaaagaatcaaattccctggaaggggtacgcactaagatcgagggctatgatttcaatgcaggcgttgattattctcagcttctcaaatccatggtctccaccggcttccaagcctccaatctcggcgacgccatccaagtcgttaatcaaatggttagtttttcacttaaaacacttaaaactactcaactaattgggggttggattgattttatttgatttttcttctatggtctgtattttttttttttttttttgttaatttttttgttaatggggtgaagctagactggaggctttctgatgagagtccggcggaggattgcagcgaggaggagagggatgaaaagtatagaaaatcggtgaagtgcaaagtgtttctgggtttcacttccaatctgatttcgtcgggtgtgagagatacagtgcgatatcttactgagcatcatatggtgagttttgctttggagatggctttccagaaaggatgtgatttttgtgactttctatgtttgattctagaacatttatcaaaagataaagacttcatcttttgtgtatatatactgtaaataatgtagaggcgaaaatgggcattagttttaatagtttatatgaatgaattgtgctcaaataattggcatctcaaataagttttgcttcttatgggcttgcagtatcatatttttccagtgaaagaggcaccttggctttgatttatggtttgcaatctttttaggttaatctcaaatgttttaaggtgctaattttgaatgtttttcataatactggggcacgagctcacacaagataatgggatgttagggaacctctatcctgtactaaagactaagtcgactcactgatgagctctatataagaatgggctattaggctatgtttggtcccagaaaatttgagggaaaatacgagggaaagaaaatagagatgaaaagtagaaaaagtgaaagaaaataaaaaatagatagaaagtcaataaattattttaggtacctcttcaaacttatttcacttattttcctccattgtataaagattacataatttcaaaatgcataaatttctaattaattataaatatatttggctttctttcgtatttgtcatggtgaaaccaaacacgagaaaacaatttttcttagcatttttttctttccttggtactttccgacaaccaaacatagctttaaggaactttgagtcagtaaaagaacacagagcaaagaccaagccaatgcaccgatcacaaagttgtcttggtttacggttgtgagttggagaacacccaggacaccttaaagtaagaggttaaaaataaggctttcctacgtcaattcctttggaagaaattggataaggcttttactcgctttgacattatttaatctaaatttaattcttagtattgcaactcttcatcaatatggcttctaggtcatgacgcatgaaaggtttttggcagtttgctgtcatattattacatttttgctttgttttcaactccattacttgaacttcaggattgttacttttaatataactgcaggttaattgttcgttgttaatgttggactttgtggattgattatctatgtagaccgtggttgctgttttttctgcctccatgccgttcgtttggccttttggcttcttcatatacatcatgtgtaccttcatgcttttcttttgttgatagtacaacctttacttatatattaaaaaaaaaacatttcaggttgatgtggtggttacaacagctggtggcatagaagaggatcttattaaatgccttgcacccacatacaaaggtgatttttatctatccggtactcatttacgctcaaaaggattgaaccgcattggtaacttgttggttcccaatgacaactactgcaaatttgaggattggattattccgatctttgaccagatgttgaaggagcaaacttcggaggtatttcaattttccttttatcatgattctatgaatacttagtggttgttgtcttgtcataaatactcttcttgttagaattggttttccatctagtcagcttgttgttacatggttttagtacatccctgatatgtacccttgaactttaattgtcatatctttaaccatgctttgaaagaagtcataggatacctatcatgttatattagatgttaatatactatgttttataaaaggaatatgatgacttatcaaaaaaataaataaaaataaaaggaatatgatgactcatgatgttttcttcttgatgtatacaagttctgttgaaccgtatcattttagctttacattatcttacttgagtttgcttgaggttacttgcgctcatattagtagcatatttaagcattgctcggctgcacatgaatcttgaatatttaaccttgagtttgcttgagtctctcattctctctttcattgtttttaatgttcactttatttgtgactggagccagttgatcaacctgtttgttagtaactggttcactctgctggtcttgtccaagtttgacaacattgcaatgaagagatccccctgagtcatgcagtgctctagaacattgccctgtcttccatcttacattttttctgtttgttttacagaatgtattgtggacaccttctaaggtaattgctcgcttgggaaaagaaatcaataatgagagttcatacctttattgggcatacaaggtaaatgtttaccaggttgagcttaattttatgcacacaagtcgaatttatttttttattctattgatagacaaacaaaaaataggtattgataaaaagtctagcaaaaagtgtaccccaagtatagcatttgcaatggacgttgaacaacaaagaaacaagaagagagaaatgacaaaaacaactccctccccctacttatagtccaaccaatcaaccaaaactgcaatacacaagccagaatttaccctccatggtatataaagtgatccataccttcaatgtgaatttaagacaagtgtttaaacatgtcaagcttaatttttatagacaagcataaatttttcttacaatatggattagttacattgctatggtgcagtcatgattatcttgttctcaattttttttttcttttttttttattagtattattaatgaaagttttttagtgatatacatttcttctgcatgctatggtaatgttacatataatgatggttttgtacttagtggatgggaactgcgatattaggtgatttttgttccctaggtggaattgtggatccaattcctagctagaaattcagaatgttgtaagaccaatggcattcttatgtcaaattcttactttcatcatgatataactttgaattaatcggaaagaaagcaaagttctcaagcacctcaaaattttcatttgaaacttggctcataatatgggaaaggaaaggaaaagaaaggtgtttaaatagtggagtttactggtatgatctcacatggaggaaaagttcctgacagtatatatgtagtgggcttctctctactgtatttacctgttttaaagtcctgaggatatcaatccataatgcataatatctatatgagagggaaggatcagcaagcttaaaaccacatgcatttgccaaactgttatataaaacctcacttggaatctcagagaccccatttacagcatgcaagctaccaaccggtaaagggatgacgtccactatatcttttgcaggagccttatggggaaatgttgaactttcttctagaaatttgacataattgtgagatgttggctggccatgaatccactgagacaaatacagagcattcggagggttctcattctttccagaccccccggtaaagtgatggctaggatcatcttttggtacataagatgcatcattaatactcccaccaaaagaaaatgacatcaactgcagaggattctcatgcccactttgttcttccatattacccatggcaaaagcatctcatgcccactttgaagattctgaattagcggatcaagctattttacggtcttttttgtacatgttctcagattgggttagggtgcatgtaaattgtgcttcatggtccattttcgatttcattgattggttgggttgtaagtaagggttttttttgttttttctctccctttggcccagttgtcttgtatactccgtgtatactgtcaggtgtactttaggctttctaatacaattgcttttacttatcaaaaaaaaaaaaaaaaatctatatgagagggagtagattattagaaacactatgagagttgaaccttgaactcagtatgggatgtggagtgactgttctgattagcacgacaatctcatcagaacacaatgtggactttgtgcctgtgttgggggcaagttatttcaatatcacagataagttcctgatatatagtaagattcttttaactatgtggactttttctaaaaatcaagctttccttgacccaacacggacaatatcaatatctacatgggaaattaatgtgtttgaattgttctatcaaaaaatatctacacaggagggattgagccattacattaccagaaaaaagttctaaagagctacattcagacggttttatagaaatatacctcctcaatagttatgtatcctgttgtctcttttcagaatgctattcctttctaactttaacttgataaacacctagtttacgccatatttatgatattcttttggttacacttttcagaacaatattccagtcttctgcccgggtttaaccgatggctcattaggggacatgttatacttccattccttccgcaatcctggtctgatcattgacatagtgcaaggtaaccgtttcctctgtctatgtccttgctgaccaatatataactgctttggcacatgaaactacaattggtcactctttgaacagatattagggccatgaatggtgaagctgtccatgcaaatcctagaaagactggaatgataattcttggagggggcatgcccaagcatcacatttgtaatgccaatatgatgcgtaatggtgctgattatgctgtcttcatcaacacagcacaagagtttgatggaagtgattctggagctcgccctgatgaggctgtgtcatgggggaaaatacggggttctgccatgactgttaaggtttaaactcatttatcccttgtttttgctttatcaaataaccttctgtttccttgcatttaccagttgtattgttctggtctcagataattcctcatatactctttaatcagacataagaggaaaaactatggttctgattctttttcctgtttttggatggtttcaaccaggtacattgtgatgcaactattgcttttccccttctggttgcagaaacatttgctgcaaagataagcaagcctctctga

SEQ ID NO: 486 - DNA, 195 bp, Vitis vinifera
  misc_feature: exon 1
atggaagagaatttcctatcatctgtacgatcggtagtcttcaaagaatcaaattccctggaaggggtacgcactaagatcgagggctatgatttcaatgcaggcgttgattattctcagcttctcaaatccatggtctccaccggcttccaagcctccaatctcggcgacgccatccaagtcgttaatcaaatg

SEQ ID NO: 487 - DNA, 131 bp, Vitis vinifera
  misc_feature: intron 1
gttagtttttcacttaaaacacttaaaactactcaactaattgggggttggattgattttatttgatttttcttctatggtctgtattttttttttttttttttgttaatttttttgttaatggggtgaag

SEQ ID NO: 488 - DNA, 168 bp, Vitis vinifera
  misc_feature: exon 2
ctagactggaggctttctgatgagagtccggcggaggattgcagcgaggaggagagggatgaaaagtatagaaaatcggtgaagtgcaaagtgtttctgggtttcacttccaatctgatttcgtcgggtgtgagagatacagtgcgatatcttactgagcatcatatg

SEQ ID NO: 489 - DNA, 1304 bp, Vitis vinifera
  misc_feature: intron 2
gtgagttttgctttggagatggctttccagaaaggatgtgatttttgtgactttctatgtttgattctagaacatttatcaaaagataaagacttcatcttttgtgtatatatactgtaaataatgtagaggcgaaaatgggcattagttttaatagtttatatgaatgaattgtgctcaaataattggcatctcaaataagttttgcttcttatgggcttgcagtatcatatttttccagtgaaagaggcaccttggctttgatttatggtttgcaatctttttaggttaatctcaaatgttttaaggtgctaattttgaatgtttttcataatactggggcacgagctcacacaagataatgggatgttagggaacctctatcctgtactaaagactaagtcgactcactgatgagctctatataagaatgggctattaggctatgtttggtcccagaaaatttgagggaaaatacgagggaaagaaaatagagatgaaaagtagaaaaagtgaaagaaaataaaaaatagatagaaagtcaataaattattttaggtacctcttcaaacttatttcacttattttcctccattgtataaagattacataatttcaaaatgcataaatttctaattaattataaatatatttggctttctttcgtatttgtcatggtgaaaccaaacacgagaaaacaatttttcttagcatttttttctttccttggtactttccgacaaccaaacatagctttaaggaactttgagtcagtaaaagaacacagagcaaagaccaagccaatgcaccgatcacaaagttgtcttggtttacggttgtgagttggagaacacccaggacaccttaaagtaagaggttaaaaataaggctttcctacgtcaattcctttggaagaaattggataaggcttttactcgctttgacattatttaatctaaatttaattcttagtattgcaactcttcatcaatatggcttctaggtcatgacgcatgaaaggtttttggcagtttgctgtcatattattacatttttgctttgttttcaactccattacttgaacttcaggattgttacttttaatataactgcaggttaattgttcgttgttaatgttggactttgtggattgattatctatgtagaccgtggttgctgttttttctgcctccatgccgttcgtttggccttttggcttcttcatatacatcatgtgtaccttcatgcttttcttttgttgatagtacaacctttacttatatattaaaaaaaaaacatttcag

SEQ ID NO: 490 - DNA, 219 bp, Vitis vinifera
  misc_feature: exon 3
gttgatgtggtggttacaacagctggtggcatagaagaggatcttattaaatgccttgcacccacatacaaaggtgatttttatctatccggtactcatttacgctcaaaaggattgaaccgcattggtaacttgttggttcccaatgacaactactgcaaatttgaggattggattattccgatctttgaccagatgttgaaggagcaaacttcggag

SEQ ID NO: 491 - DNA, 666 bp, Vitis vinifera
  misc_feature: intron 3
gtatttcaattttccttttatcatgattctatgaatacttagtggttgttgtcttgtcataaatactcttcttgttagaattggttttccatctagtcagcttgttgttacatggttttagtacatccctgatatgtacccttgaactttaattgtcatatctttaaccatgctttgaaagaagtcataggatacctatcatgttatattagatgttaatatactatgttttataaaaggaatatgatgacttatcaaaaaaataaataaaaataaaaggaatatgatgactcatgatgttttcttcttgatgtatacaagttctgttgaaccgtatcattttagctttacattatcttacttgagtttgcttgaggttacttgcgctcatattagtagcatatttaagcattgctcggctgcacatgaatcttgaatatttaaccttgagtttgcttgagtctctcattctctctttcattgtttttaatgttcactttatttgtgactggagccagttgatcaacctgtttgttagtaactggttcactctgctggtcttgtccaagtttgacaacattgcaatgaagagatccccctgagtcatgcagtgctctagaacattgccctgtcttccatcttacattttttctgtttgttttacag

SEQ ID NO: 492 - DNA, 87 bp, Vitis vinifera
  misc_feature: exon 4
aatgtattgtggacaccttctaaggtaattgctcgcttgggaaaagaaatcaataatgagagttcatacctttattgggcatacaag

SEQ ID NO: 493 - DNA, 2053 bp, Vitis vinifera
  misc_feature: intron 4
gtaaatgtttaccaggttgagcttaattttatgcacacaagtcgaatttatttttttattctattgatagacaaacaaaaaataggtattgataaaaagtctagcaaaaagtgtaccccaagtatagcatttgcaatggacgttgaacaacaaagaaacaagaagagagaaatgacaaaaacaactccctccccctacttatagtccaaccaatcaaccaaaactgcaatacacaagccagaatttaccctccatggtatataaagtgatccataccttcaatgtgaatttaagacaagtgtttaaacatgtcaagcttaatttttatagacaagcataaatttttcttacaatatggattagttacattgctatggtgcagtcatgattatcttgttctcaattttttttttcttttttttttattagtattattaatgaaagttttttagtgatatacatttcttctgcatgctatggtaatgttacatataatgatggttttgtacttagtggatgggaactgcgatattaggtgatttttgttccctaggtggaattgtggatccaattcctagctagaaattcagaatgttgtaagaccaatggcattcttatgtcaaattcttactttcatcatgatataactttgaattaatcggaaagaaagcaaagttctcaagcacctcaaaattttcatttgaaacttggctcataatatgggaaaggaaaggaaaagaaaggtgtttaaatagtggagtttactggtatgatctcacatggaggaaaagttcctgacagtatatatgtagtgggcttctctctactgtatttacctgttttaaagtcctgaggatatcaatccataatgcataatatctatatgagagggaaggatcagcaagcttaaaaccacatgcatttgccaaactgttatataaaacctcacttggaatctcagagaccccatttacagcatgcaagctaccaaccggtaaagggatgacgtccactatatcttttgcaggagccttatggggaaatgttgaactttcttctagaaatttgacataattgtgagatgttggctggccatgaatccactgagacaaatacagagcattcggagggttctcattctttccagaccccccggtaaagtgatggctaggatcatcttttggtacataagatgcatcattaatactcccaccaaaagaaaatgacatcaactgcagaggattctcatgcccactttgttcttccatattacccatggcaaaagcatctcatgcccactttgaagattctgaattagcggatcaagctattttacggtcttttttgtacatgttctcagattgggttagggtgcatgtaaattgtgcttcatggtccattttcgatttcattgattggttgggttgtaagtaagggttttttttgttttttctctccctttggcccagttgtcttgtatactccgtgtatactgtcaggtgtactttaggctttctaatacaattgcttttacttatcaaaaaaaaaaaaaaaaatctatatgagagggagtagattattagaaacactatgagagttgaaccttgaactcagtatgggatgtggagtgactgttctgattagcacgacaatctcatcagaacacaatgtggactttgtgcctgtgttgggggcaagttatttcaatatcacagataagttcctgatatatagtaagattcttttaactatgtggactttttctaaaaatcaagctttccttgacccaacacggacaatatcaatatctacatgggaaattaatgtgtttgaattgttctatcaaaaaatatctacacaggagggattgagccattacattaccagaaaaaagttctaaagagctacattcagacggttttatagaaatatacctcctcaatagttatgtatcctgttgtctcttttcagaatgctattcctttctaactttaacttgataaacacctagtttacgccatatttatgatattcttttggttacacttttcag

SEQ ID NO: 494 - DNA, 106 bp, Vitis vinifera
  misc_feature: exon 5
aacaatattccagtcttctgcccgggtttaaccgatggctcattaggggacatgttatacttccattccttccgcaatcctggtctgatcattgacatagtgcaag

SEQ ID NO: 495 - DNA, 86 bp, Vitis vinifera
  misc_feature: intron 5
gtaaccgtttcctctgtctatgtccttgctgaccaatatataactgctttggcacatgaaactacaattggtcactctttgaacag

SEQ ID NO: 496 - DNA, 236 bp, Vitis vinifera
  misc_feature: exon 6
atattagggccatgaatggtgaagctgtccatgcaaatcctagaaagactggaatgataattcttggagggggcatgcccaagcatcacatttgtaatgccaatatgatgcgtaatggtgctgattatgctgtcttcatcaacacagcacaagagtttgatggaagtgattctggagctcgccctgatgaggctgtgtcatgggggaaaatacggggttctgccatgactgttaag

SEQ ID NO: 497 - DNA, 173 bp, Vitis vinifera
  misc_feature: intron 6
gtttaaactcatttatcccttgtttttgctttatcaaataaccttctgtttccttgcatttaccagttgtattgttctggtctcagataattcctcatatactctttaatcagacataagaggaaaaactatggttctgattctttttcctgtttttggatggtttcaaccag

SEQ ID NO: 498 - DNA, 78 bp, Vitis vinifera
  misc_feature: exon 7
gtacattgtgatgcaactattgcttttccccttctggttgcagaaacatttgctgcaaagataagcaagcctctctga

SEQ ID NO: 499 - DNA, 3905 bp, Zea mays
gctgtctcacacggctgcggctgcggcggttcgggcgctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccatcggactccaggggctgctcgcctcgctcgcgtccaccgggttccaggcatccaacctcggcgacgccatcgacgtcgtcaaccagatggtacgtcgctcgctacgctgctgtttccgtcacttgggggttttttaactgtagcgagcgacctagaggaggagataggtttatgtggttttgtgcgatgcgaggtctgctgtattgtgttttgtgttggacctcgggcgaattcatgtttaggtcgcctggattttgttctggaaatgcatggatgcgccaagtcattcgaagacacggccaagcggataggtgtccagctgttacagcttcctcggtgatgtaggtatatttgaattcgcggtaacagtgaaagggccccaagtatgcgggttaaagttttcacctaaatccagcaacacagacataaaattgctatggaagtttctgctttttgttgtatattgctgccaagtaaacatttgtagttggacttggacttgccttccgtttaaggtagagccacctaaatcacaaaaaatacctttgctcttacaatattgcctcggcatatttattgagtttcagttttgtcgaatccactactatggtttctgaggttctgatatttgctatgcttggctgaactaaagttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatggtaaactctccaactctgtatcacaagtgcaagtttagattgaaaagaagtttcgacgcccctatgtaaagtggtctattaccagatgcgttgagctctagtgttctaatgccactaacttcttcaatgaaaaattatgttctttaggtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgaggtaagcatccctgctgggtcaaagctatcaaatattcttctggctgaaacaaatgtacttgctaaccatggctttcatttgtcctatgcagttgctattagatactagaagtgtaatatgaatatgtttttttttgcaatctgtaaaatgtttcttttagagggctgtagatttttctactatctgtgacactgataagcaggaaggaaaagcctaacatggaatcaatctatgacatggatccaaaagttctttaaaaactatttgtgtagcatgtcacacttaatgtactaaaaagattaaaaaaaactatgggcattcgtttgacctttcttgaataaattattttttatcggcattatactttttatggcctttagagtgatgaccttctgttttctctttctagtaatatgcatatgaacttgaatagccagacaagtgagatcttgccaaaccaaatatttgaagtctgagctatagttccttcagaagttgctgagtatcgatacagattacagagaaggttacacctcactggatatttgatgttttaactcaggagcagcctgaattttcacatcaataatgttttgtaatagatcacctgccagctctggtgtatcagtaattgatcttgttttttctggaaacaagaggagaaccatatttatatctttgtcatgtatcaatctattgttccttgcagaatgtttggacaccgtcgaaggtgatagcgcgccttggcaaagaaataaatgatgaaagctcctatctttattgggcatacaaggtaacatataactgtgtatgcttaggaagtattaaaagaacttcagaaatgggaccgttcctcttttatttgtgtatgatattttttagggggagagggatgtaaaaagtaattaaagttctgttgagttatgtggccaagttattgttgctttaccgtgtgatctatttttcactgtcccaggagtcatgtattttctccggatagttgcattttctgacttgaaccttcccatctcattgattaatgcactgtgtttgtatacctgatatctatgttcgaaccttttttttagaattgttcagggcttagtagattgaagcagtataaaataactgttattctggcttacccttccctgttacatatatttttcattggtgtttgtgcttttttttatactggagttcttaacttcatgagctattttgttgatttacatctcaagtcaatagtcgtcacactgtactaactcgtcagtacttgaccagaataacatccctgtatactgcccagcattgactgatggatcacttggagacatgctgttctgtcatgcagttcgtaatcctggccttattattgacattgtacaaggtatgattcactgttctgtccttgtctttgctttcttatgcaacattgagcttgaaatctttacagatatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaaggtatatgttccttcacgaagcttcagatgctgtttgttatgtttcacataactctagttaaacttactctggtaaacatcatgctgcacacaaactcttgcagttgatttgtcttgcaacgaggtatcaaaacaatcgaaaagtatatttttattagggtcgaaaagtatataaaaagctgtttcttaatttctaaaacaacttaacttctgtcactgtgggcaacttctgcactggcagaatgttagaacgctgcattttgggcttcaaacatgcaccatcttacattctctaataatcgtaatgaattatgacctgattatttaatcgtactttatcttctaatagaagatatcaagaagaaaccagcataatgggagagggagagcacatattagtctagcaaatctaatccgttgtttgaactggaaatgcaggtgcattgcgatgcaagtatcgctttcccgcttcttgttgcagcaacatttgcacgtaaggttcataactccaaatgaacagactgaatcggattcggtggagtgaatgggcaacagaattttgttgaactctccaaatgacctcttttggagcacgaggtctacttcacctgcacagggatcatgtgcaagttttttcggtgactcgcggcaaccacatgccatcattattcgatgttcacttgatgctgtactagctggttgatagcatttttgttacaactgataatttattgaaatacagacatacgattgttcatccgagtcgtctgcttacgaattttttgtagacgaaacatctgcttacgaaattgacaaatggcctgttttatgaacacatttttt

SEQ ID NO: 500 - DNA, 24 bp, Zea mays
  misc_feature: exon 2
cggctgcggctgcggcggttcggg

SEQ ID NO: 501 - DNA, 237 bp, Zea mays
  misc_feature: exon 3
ctccagactccagggatggccgccggtgcgggaggcggcgaactggaggcgctggagggcgtgcgctccatcgtgctcaagccgtcggagtcgctcgacgagtcgcggttcacgaggatcgccggcgccgacttcaacgacccggccatcggactccaggggctgctcgcctcgctcgcgtccaccgggttccaggcatccaacctcggcgacgccatcgacgtcgtcaaccagatg

SEQ ID NO: 502 - DNA, 563 bp, Zea mays
  misc_feature: intron 3
gtacgtcgctcgctacgctgctgtttccgtcacttgggggttttttaactgtagcgagcgacctagaggaggagataggtttatgtggttttgtgcgatgcgaggtctgctgtattgtgttttgtgttggacctcgggcgaattcatgtttaggtcgcctggattttgttctggaaatgcatggatgcgccaagtcattcgaagacacggccaagcggataggtgtccagctgttacagcttcctcggtgatgtaggtatatttgaattcgcggtaacagtgaaagggccccaagtatgcgggttaaagttttcacctaaatccagcaacacagacataaaattgctatggaagtttctgctttttgttgtatattgctgccaagtaaacatttgtagttggacttggacttgccttccgtttaaggtagagccacctaaatcacaaaaaatacctttgctcttacaatattgcctcggcatatttattgagtttcagttttgtcgaatccactactatggtttctgaggttctgatatttgctatgcttggctgaactaaag

SEQ ID NO: 503 - DNA, 168 bp, Zea mays
  misc_feature: exon 4
ttagactggaggttgtcgcatgagaagcccagcgaggattgtgatgaagctgaacttgaccctaaatatagagcatctgtgaagtgcaagatatttctgggcttcacctcgaacctcgtgtcttctggcatccgggatataatccgttttctagctcagcatcacatg

SEQ ID NO: 504 - DNA, 147 bp, Zea mays
  misc_feature: intron 4
gtaaactctccaactctgtatcacaagtgcaagtttagattgaaaagaagtttcgacgcccctatgtaaagtggtctattaccagatgcgttgagctctagtgttctaatgccactaacttcttcaatgaaaaattatgttctttag

SEQ ID NO: 505 - DNA, 219 bp, Zea mays
  misc_feature: exon 5
gtggatgttattgttacaagtgctgggggtatagaggaggatctcattaaatgccttgcaccaacttacagaggcgatttttctttacctggagcactgctgcggtcaaaaggactgaaccggataggaaatctgttggtgcccaatgacaactattgcaagtttgagaactggatcatgccactcttcgaccagatgctacaggagcaatctactgag

SEQ ID NO: 506 - DNA, 709 bp, Zea mays
  misc_feature: intron 5
gtaagcatccctgctgggtcaaagctatcaaatattcttctggctgaaacaaatgtacttgctaaccatggctttcatttgtcctatgcagttgctattagatactagaagtgtaatatgaatatgtttttttttgcaatctgtaaaatgtttcttttagagggctgtagatttttctactatctgtgacactgataagcaggaaggaaaagcctaacatggaatcaatctatgacatggatccaaaagttctttaaaaactatttgtgtagcatgtcacacttaatgtactaaaaagattaaaaaaaactatgggcattcgtttgacctttcttgaataaattattttttatcggcattatactttttatggcctttagagtgatgaccttctgttttctctttctagtaatatgcatatgaacttgaatagccagacaagtgagatcttgccaaaccaaatatttgaagtctgagctatagttccttcagaagttgctgagtatcgatacagattacagagaaggttacacctcactggatatttgatgttttaactcaggagcagcctgaattttcacatcaataatgttttgtaatagatcacctgccagctctggtgtatcagtaattgatcttgttttttctggaaacaagaggagaaccatatttatatctttgtcatgtatcaatctattgttccttgcag

SEQ ID NO: 507 - DNA, 84 bp, Zea mays
  misc_feature: exon 6
aatgtttggacaccgtcgaaggtgatagcgcgccttggcaaagaaataaatgatgaaagctcctatctttattgggcatacaag

SEQ ID NO: 508 - DNA, 491 bp, Zea mays
  misc_feature: intron 6
gtaacatataactgtgtatgcttaggaagtattaaaagaacttcagaaatgggaccgttcctcttttatttgtgtatgatattttttagggggagagggatgtaaaaagtaattaaagttctgttgagttatgtggccaagttattgttgctttaccgtgtgatctatttttcactgtcccaggagtcatgtattttctccggatagttgcattttctgacttgaaccttcccatctcattgattaatgcactgtgtttgtatacctgatatctatgttcgaaccttttttttagaattgttcagggcttagtagattgaagcagtataaaataactgttattctggcttacccttccctgttacatatatttttcattggtgtttgtgcttttttttatactggagttcttaacttcatgagctattttgttgatttacatctcaagtcaatagtcgtcacactgtactaactcgtcagtacttgaccag

SEQ ID NO: 509 - DNA, 106 bp, Artificial Sequence
  Synthetic (Zea mays exon 7)
  misc_feature: exon 7
aataacatccctgtatactgcccagcattgactgatggatcacttggagacatgctgttctgtcatgcagttcgtaatcctggccttattattgacattgtacaag

SEQ ID NO: 510 - DNA, 66 bp, Zea mays
  misc_feature: intron 7
gtatgattcactgttctgtccttgtctttgctttcttatgcaacattgagcttgaaatctttacag

SEQ ID NO: 511 - DNA, 236 bp, Zea mays
  misc_feature: exon 8
atatacggctgatgaatggggaagccatccatgcaacaccaaggaagacagggattatagttcttggtggaggccttccaaagcatcatatatgcaatgccaatatgttccgcaatggtgcagattatgctgtctatattaacacggctcaagagtttgatggtagcgattctggagcacaccccgatgaagcagtctcatggggcaagatcaagggttcagcaaaacctgtaaag

SEQ ID NO: 512 - DNA, 437 bp, Zea mays
  misc_feature: intron 8
gtatatgttccttcacgaagcttcagatgctgtttgttatgtttcacataactctagttaaacttactctggtaaacatcatgctgcacacaaactcttgcagttgatttgtcttgcaacgaggtatcaaaacaatcgaaaagtatatttttattagggtcgaaaagtatataaaaagctgtttcttaatttctaaaacaacttaacttctgtcactgtgggcaacttctgcactggcagaatgttagaacgctgcattttgggcttcaaacatgcaccatcttacattctctaataatcgtaatgaattatgacctgattatttaatcgtactttatcttctaatagaagatatcaagaagaaaccagcataatgggagagggagagcacatattagtctagcaaatctaatccgttgtttgaactggaaatgcag

SEQ ID NO: 513 - DNA, 143 bp, Zea mays
  misc_feature: exon 9
gtgcattgcgatgcaagtatcgctttcccgcttcttgttgcagcaacatttgcacgtaaggttcataactccaaatgaacagactgaatcggattcggtggagtgaatgggcaacagaattttgttgaactctccaaatgacc

SEQ ID NO: 514 - DNA, 260 bp, Zea mays
  misc_feature: exon 10
ttttggagcacgaggtctacttcacctgcacagggatcatgtgcaagttttttcggtgactcgcggcaaccacatgccatcattattcgatgttcacttgatgctgtactagctggttgatagcatttttgttacaactgataatttattgaaatacagacatacgattgttcatccgagtcgtctgcttacgaattttttgtagacgaaacatctgcttacgaaattgacaaatggcctgttttatgaacacatttttt

SEQ ID NO: 515 - DNA, 4462 bp, Zea mays
ccttgtgttttcatcctccttgaagcgaaaacgatcgagcttactgtatcgcaggcatttcggtacactacgttctccggctgtgtagagctgtgcgcagatgggtgccgagttgggagaagcgggtgtccctgcccgggacatggtggacgcgctggaaggcgtgcgctccatcctgctgaaaccgtcggagcgcctcgacgacaagcgcttcacgaggatcgccggcgccgacttcgacgacgccggcctcggcctcgccgggttgctcggctcgctcgcgtccacggggttccaggcctccaacctcggcgacgccatcgacgtcgtcaaccagatggtacgctttgcatggcaaactcgctcgcgcggacgagaatcccacgaaaactgcgaagtaactgatatattcattttcccgaaagaaatatagaattcatgctattgttgttctttattacctcatcgttatgctacagaaagtcacatgcttcgtatcagcatcgatacggcttaaaaaacgtaatcatatactactaagaaagaaacagtttgaccatcttatatatattccaacaaaatattcagtgcaaattaccgttcaggcgctcactaccgaaatcgagcgctttacttaatgcttaaaaaacactcagcagagagagctcggcgaacagtacatcgacaacagcttctttgtcgagtactttttattggcactcgtcaaaaactttgcagacagtcgggactcgacaaagaaagctgtcgtcatggcgccggataacggagacggcgcctttgccgagtgttctagttgacactcgacaaagaagttacctttaccgagtgtcacctaatacactcggcaaaaaagttatctctttgtcgagtgtctgccagcctgcactcggcaaagggtcccaagtgctctagatgacactcggcaaagtttgcttttttgtcgagtgccagagccacaacactcggcaaaaaagatttactggtacccagaaaatctgaggtcatacaaagccgtatatatatgtgcttcgtgacaaaagttgagctgcaacctggttttaatttgtaaaaactcagagatgacaagtttaacatttacaagaactaggagcacatccgtggtccagaagcactgttgaaaacagcttttacttcgatgccatctgtttagatagtgtttgtttgaaattataatttgttcaaattatataacctaactcacctatctcaaaacaagttatattatataagttcaaaacaagttatattatttaatctaagtagattataatcccaaatatacatatacatatatatatatatatatatatatatatattctccgatgttttgatctaaataaaacagcggacagaaaatggcttggaaagtcctgtgtgttcagtttaggctttctttggaacacactaacttcacaagcattagttaatttcacacatcaaaaaagaaacaaagaaatgcaggaataggaaattttcccatgttctagatcgggcctgttgtaatctgtctgtccagggacagcagaatacaataggatgaagatgggagtggtttaatgcctctaaacacatgacgtcaaggcaaaagtgattcttctttccgtctcccgctttgccacgatacgggatatttataggtaaccaagagaccacccgaccttatcaaagacaattaggccctcagttacctagtttatcctcggaatattctctcatataagattacagtgtgtcattacagcatactttattataagcgcggcctaacccgctctgccctacatagcgcctacgggcaaggccctatgacataggctggattgcacatgtgctccttctcgcattgagggagacaaagtcttgtggtcttcacagcctcggtcactcggtccttgaagtcattgatggtattcgccttggcttgttggagcgaagggggcacttgggccttcgcacggacgacgtccacggcccggccggcggagcctactagcacggtcttcagcctgcggaatattgatgcagaagttgacgagcgagagataggcgtgttcgcctttgcccaacagggccttaataattttggacttaataattggatgttatttttttttcagttctgcattagtgggtactctcctttgcaaggttcctaactatgttttcgtgctcacgctttctgctgttgtgcgcttcgctggatggaagttggactggaggttgtcccacgagaagccaagcgacgactgcgctgaagctgaactcgatcctgcgtacagagaatccgtcaagtgcaagatattcctggggttcacttcgaaccttgtgtcttccggtgttcggggagatcatccggtttcttgttcagcatcgcatggtgaattctccaacttactgcatcgaaattaaacaagaaaaacaagtttaaatatcttatttcaacatttatttcctcgcatgaaatgtttctcgatctctaggtggacgttattgttacgactgctgggggtatagaggaggacctcatcaaatgccttgcgccaacctacagaggcgacttcactctgcccggagcgctgctgcggtccagaggacttaaccggataggaaacctgctggtgcccaatgacaactactgcaagttcgagcactggatcatgccgatcctcgacaagatgctgctggaacagtccacccaagtaagcaatcaagcacaaatgtgacctaaattccacacattaattggtgcgtcctgttcttccagaggcattagtatccaagtatgtttctcatggtgtccggccgtggttttctttcttgcctgcagaatgtttggacgccgtccaaggtgattgctcgccttggcaaggaaataaatgacgaaagctcctacctttattgggcgtacaaggtaattagcaagcttaagggtgtgtttggtttggcttttggctttggcttttgccccctaaaagccaaagccaaaccaaagggctagatccagaaagcagctttttctaaaagctgactttctcgcagtgcaaaactgaaagcacccttggacctgcttttagtggcttttggatgaaactgtgaaaacatatatttaagaacttttaacggcttttagtggtttccaccaaacggtttttagctttttaacagctcacagcccacagcagctttttccacagctcacagcccacagtagcttttttcacagccacagcccaaccaaacagaccctaaataatactggcttcgaacttctgcactctttattacaaagcagaaaacacatgggaacatctcaaagactgactcgtcaaaaaaacttgagcagaacaacatccctgtgttctgcccagcattgactgacggatcaattggggacatgctgttctgtcactcggttcacagtccaggtcttgttgtcgacattgtacaaggttggtttgacttaatttctatgctttgtaccttttttttttactttttccttcttcttttttttttctctctctccatatagatgatgcttgaaatctttactagatgtacggctgatgaacgcggaaaccatccacgcaagcccaaggaagacagggattatactccttggcggaggccttccgaagcatcatatatgcaacgccaatatgctgcgcgacggagctgactatgcggtgtatgtcaacacagctcaggagttcgatggcagtgattccggggcgcggcctgacgaagcggtttcatggggaaagatcaagagctcagcgagaactgtgaaggtatttatttacacatatccttcagcatactgttactgttcacctccctttttggccatgttcatgatctgtagtgggattcagtttgttgatttatttgcaaaggcacatattttaagtggtagagacagttgattggattatgtatcactctctcccatgtagggttaagttttgttcacttgatgactatttaaataagaaactgtcatacaagataggaaggtaactaaatgtttcaaacacttgaaaatgctaaatgtttcaaacacttgaaaatgcaggtgcattgtgatgcgacgattgcctttccacttcttgtggctgcaacatttgcacgcaaggttcacggcactaaatcaacaaactgaatcggaggcagtgaaattaaaatatggcgctctataactagctgaaactttcctcatatgatggttgagcttgaagcatgaacttttatttgcttgaagggtgtctatctcttagctcgtttactatttatacattactgtaacatatgtatgatatatattcatttgaaaccatttgggttattatcatacaataaaacttgtgtgtacgagaacatttgtgaccctctcttcaaattctcaaaattgttgctct

SEQ ID NO: 516 - DNA, 42 bp, Zea mays
  misc_feature: exon 1
ccttgtgttttcatcctccttgaagcgaaaacgatcgagctt

SEQ ID NO: 517 - DNA, 47 bp, Zea mays
  misc_feature: exon 2
gtatcgcaggcatttcggtacactacgttctccggctgtgtagagct

SEQ ID NO: 518 - DNA, 246 bp, Zea mays
  misc_feature: exon 3
gcgcagatgggtgccgagttgggagaagcgggtgtccctgcccgggacatggtggacgcgctggaaggcgtgcgctccatcctgctgaaaccgtcggagcgcctcgacgacaagcgcttcacgaggatcgccggcgccgacttcgacgacgccggcctcggcctcgccgggttgctcggctcgctcgcgtccacggggttccaggcctccaacctcggcgacgccatcgacgtcgtcaaccagatg

SEQ ID NO: 519 - DNA, 1912 bp, Zea mays
  misc_feature: intron 3
gtacgctttgcatggcaaactcgctcgcgcggacgagaatcccacgaaaactgcgaagtaactgatatattcattttcccgaaagaaatatagaattcatgctattgttgttctttattacctcatcgttatgctacagaaagtcacatgcttcgtatcagcatcgatacggcttaaaaaacgtaatcatatactactaagaaagaaacagtttgaccatcttatatatattccaacaaaatattcagtgcaaattaccgttcaggcgctcactaccgaaatcgagcgctttacttaatgcttaaaaaacactcagcagagagagctcggcgaacagtacatcgacaacagcttctttgtcgagtactttttattggcactcgtcaaaaactttgcagacagtcgggactcgacaaagaaagctgtcgtcatggcgccggataacggagacggcgcctttgccgagtgttctagttgacactcgacaaagaagttacctttaccgagtgtcacctaatacactcggcaaaaaagttatctctttgtcgagtgtctgccagcctgcactcggcaaagggtcccaagtgctctagatgacactcggcaaagtttgcttttttgtcgagtgccagagccacaacactcggcaaaaaagatttactggtacccagaaaatctgaggtcatacaaagccgtatatatatgtgcttcgtgacaaaagttgagctgcaacctggttttaatttgtaaaaactcagagatgacaagtttaacatttacaagaactaggagcacatccgtggtccagaagcactgttgaaaacagcttttacttcgatgccatctgtttagatagtgtttgtttgaaattataatttgttcaaattatataacctaactcacctatctcaaaacaagttatattatataagttcaaaacaagttatattatttaatctaagtagattataatcccaaatatacatatacatatatatatatatatatatatatatatattctccgatgttttgatctaaataaaacagcggacagaaaatggcttggaaagtcctgtgtgttcagtttaggctttctttggaacacactaacttcacaagcattagttaatttcacacatcaaaaaagaaacaaagaaatgcaggaataggaaattttcccatgttctagatcgggcctgttgtaatctgtctgtccagggacagcagaatacaataggatgaagatgggagtggtttaatgcctctaaacacatgacgtcaaggcaaaagtgattcttctttccgtctcccgctttgccacgatacgggatatttataggtaaccaagagaccacccgaccttatcaaagacaattaggccctcagttacctagtttatcctcggaatattctctcatataagattacagtgtgtcattacagcatactttattataagcgcggcctaacccgctctgccctacatagcgcctacgggcaaggccctatgacataggctggattgcacatgtgctccttctcgcattgagggagacaaagtcttgtggtcttcacagcctcggtcactcggtccttgaagtcattgatggtattcgccttggcttgttggagcgaagggggcacttgggccttcgcacggacgacgtccacggcccggccggcggagcctactagcacggtcttcagcctgcggaatattgatgcagaagttgacgagcgagagataggcgtgttcgcctttgcccaacagggccttaataattttggacttaataattggatgttatttttttttcagttctgcattagtgggtactctcctttgcaaggttcctaactatgttttcgtgctcacgctttctgctgttgtgcgcttcgctggatggaag

SEQ ID NO: 520 - DNA, 136 bp, Zea mays
  misc_feature: exon 4
ttggactggaggttgtcccacgagaagccaagcgacgactgcgctgaagctgaactcgatcctgcgtacagagaatccgtcaagtgcaagatattcctggggttcacttcgaaccttgtgtcttccggtgttcggg

SEQ ID NO: 521 - DNA, 32 bp, Zea mays
  misc_feature: exon 5
agatcatccggtttcttgttcagcatcgcatg

SEQ ID NO: 522 - DNA, 103 bp, Zea mays
  misc_feature: intron 5
gtgaattctccaacttactgcatcgaaattaaacaagaaaaacaagtttaaatatcttatttcaacatttatttcctcgcatgaaatgtttctcgatctctag

SEQ ID NO: 523 - DNA, 219 bp, Zea mays
  misc_feature: exon 6
gtggacgttattgttacgactgctgggggtatagaggaggacctcatcaaatgccttgcgccaacctacagaggcgacttcactctgcccggagcgctgctgcggtccagaggacttaaccggataggaaacctgctggtgcccaatgacaactactgcaagttcgagcactggatcatgccgatcctcgacaagatgctgctggaacagtccacccaa

SEQ ID NO: 524 - DNA, 128 bp, Zea mays
  misc_feature: intron 6
gtaagcaatcaagcacaaatgtgacctaaattccacacattaattggtgcgtcctgttcttccagaggcattagtatccaagtatgtttctcatggtgtccggccgtggttttctttcttgcctgcag

SEQ ID NO: 525 - DNA, 84 bp, Zea mays
  misc_feature: exon 7
aatgtttggacgccgtccaaggtgattgctcgccttggcaaggaaataaatgacgaaagctcctacctttattgggcgtacaag

SEQ ID NO: 526 - DNA, 432 bp, Zea mays
  misc_feature: intron 7
gtaattagcaagcttaagggtgtgtttggtttggcttttggctttggcttttgccccctaaaagccaaagccaaaccaaagggctagatccagaaagcagctttttctaaaagctgactttctcgcagtgcaaaactgaaagcacccttggacctgcttttagtggcttttggatgaaactgtgaaaacatatatttaagaacttttaacggcttttagtggtttccaccaaacggtttttagctttttaacagctcacagcccacagcagctttttccacagctcacagcccacagtagcttttttcacagccacagcccaaccaaacagaccctaaataatactggcttcgaacttctgcactctttattacaaagcagaaaacacatgggaacatctcaaagactgactcgtcaaaaaaacttgagcag

SEQ ID NO: 527 - DNA, 106 bp, Zea mays
  misc_feature: exon 8
aacaacatccctgtgttctgcccagcattgactgacggatcaattggggacatgctgttctgtcactcggttcacagtccaggtcttgttgtcgacattgtacaag

SEQ ID NO: 528 - DNA, 106 bp, Zea mays
  misc_feature: intron 8
gttggtttgacttaatttctatgctttgtaccttttttttttactttttccttcttcttttttttttctctctctccatatagatgatgcttgaaatctttactag

SEQ ID NO: 529 - DNA, 236 bp, Zea mays
  misc_feature: exon 9
atgtacggctgatgaacgcggaaaccatccacgcaagcccaaggaagacagggattatactccttggcggaggccttccgaagcatcatatatgcaacgccaatatgctgcgcgacggagctgactatgcggtgtatgtcaacacagctcaggagttcgatggcagtgattccggggcgcggcctgacgaagcggtttcatggggaaagatcaagagctcagcgagaactgtgaag

SEQ ID NO: 530 - DNA, 284 bp, Zea mays
  misc_feature: intron 9
gtatttatttacacatatccttcagcatactgttactgttcacctccctttttggccatgttcatgatctgtagtgggattcagtttgttgatttatttgcaaaggcacatattttaagtggtagagacagttgattggattatgtatcactctctcccatgtagggttaagttttgttcacttgatgactatttaaataagaaactgtcatacaagataggaaggtaactaaatgtttcaaacacttgaaaatgctaaatgtttcaaacacttgaaaatgcag

SEQ ID NO: 531 - DNA, 343 bp, Zea mays
  misc_feature: exon 10
gtgcattgtgatgcgacgattgcctttccacttcttgtggctgcaacatttgcacgcaaggttcacggcactaaatcaacaaactgaatcggaggcagtgaaattaaaatatggcgctctataactagctgaaactttcctcatatgatggttgagcttgaagcatgaacttttatttgcttgaagggtgtctatctcttagctcgtttactatttatacattactgtaacatatgtatgatatatattcatttgaaaccatttgggttattatcatacaataaaacttgtgtgtacgagaacatttgtgaccctctcttcaaattctcaaaattgttgctct

SEQ ID NO: 532 - DNA, 43 bp, Artificial Sequence
  Synthetic (Guide RNA targeting intron upstream of K149 in the DHS1 gene of Kitaake rice)
aatttctactgttgtagataagggggattagctacatcatagg

SEQ ID NO: 533 - DNA, 50 bp, Artificial Sequence
  Synthetic (DHS in Kitaake rice callus material)
gcattgatatcttatccctatgatgtagctaatcccccttgaaaaatgtg

SEQ ID NO: 534 - DNA, 41 bp, Artificial Sequence
  Synthetic (DHS in Kitaake rice callus material)
gcattgatatcttatccagctaatcccccttgaaaaatgtg

SEQ ID NO: 535 - DNA, 40 bp, Artificial Sequence
  Synthetic (DHS in Kitaake rice callus material)
gcattgatatcttatcccctaatcccccttgaaaaatgtg

SEQ ID NO: 536 - DNA, 43 bp, Artificial Sequence
  Synthetic (DHS in Kitaake rice callus material)
gcattgatatcttatccctagctaatcccccttgaaaaatgtg

SEQ ID NO: 537 - DNA, 47 bp, Artificial Sequence
  Synthetic (DHS in Kitaake rice callus material)
gcattgatatcttatccctatgtagctaatcccccttgaaaaatgtg

SEQ ID NO: 538 - DNA, 41 bp, Artificial Sequence
  Synthetic (DHS in Kitaake rice callus material)
gcattgatatcttatcccgctaatcccccttgaaaaatgtg

SEQ ID NO: 539 - DNA, 19 bp, Artificial Sequence
  Synthetic (DHS in Kitaake rice callus material)
gcattgatatctctgctgg

SEQ ID NO: 540 - DNA, 29 bp, Artificial Sequence
  Synthetic (DHS in Kitaake rice T0 plants)
gcattgatatcttatccttgaaaaatgtg

SEQ ID NO: 541 - DNA, 43 bp, Artificial Sequence
  Synthetic (DHS in Kitaake rice T0 plants)
gcattgatatcttatccgtagctaatcccccttgaaaaatgtg

SEQ ID NO: 542 - DNA, 32 bp, Artificial Sequence
  Synthetic (DHS in Kitaake rice T0 plants)
gcattgatatcttatcccccttgaaaaatgtg

SEQ ID NO: 543 - DNA, 47 bp, Artificial Sequence
  Synthetic (DHS in Kitaake rice T0 plants)
gcattgatatcttatccctatgaagctaatcccccttgaaaaatgtg

SEQ ID NO: 544 - DNA, 138 bp, Artificial Sequence
  Synthetic (DHS in Kitaake rice T0 plants)
gcattgatatcttatccccgcctaatacgcaaggaaacagctatgaccatgttaatgcagctggcacgacaggtttcccgactggaaagcgggcagtgagcggaaggcccatgaggctaatcccccttgaaaaatgtg

SEQ ID NO: 545 - DNA, 50 bp, Artificial Sequence; identical to SEQ ID NO: 533
  Synthetic (DHS in Kitaake rice T0 plants)

SEQ ID NO: 546 - protein, 7 aa, Artificial Sequence
  Synthetic (Active site of OsDHS1)
EAVSWGK

SEQ ID NO: 547 - DNA, 21 bp, Arachis duranensis
gaagctgtttcctggggaaaa

SEQ ID NO: 548 - DNA, 21 bp, Arachis ipaensis
gaagctgtttcctggggaaaa

SEQ ID NO: 549 - DNA, 21 bp, Arabidopsis thaliana
gaagccgtgtcttggggtaaa

SEQ ID NO: 550 - DNA, 21 bp, Brassica napus
gaagcagtgtcttggggtaaa

SEQ ID NO: 551 - DNA, 21 bp, Brassica rapa
gaggcagtgtcttggggtaaa

SEQ ID NO: 552 - DNA, 21 bp, Beta vulgaris subsp. vulgaris
gaggccgtgtcctggggaaag

SEQ ID NO: 553 - DNA, 21 bp, Cicer arietinum
gaggctgtttcatgggggaaa

SEQ ID NO: 554 - DNA, 21 bp, Coffea canephora
gaagctgtatcatggggaaag

SEQ ID NO: 555 - DNA, 21 bp, Camelina sativa
gaagccgtatcttggggtaaa

SEQ ID NO: 556 - DNA, 21 bp, GAAGCCGTATCTTGGGGTAAA
gaagctgtatcatggggaaaa

SEQ ID NO: 557 - DNA, 21 bp, Gossypium hirsutum
gaagctgtttcatgggggaaa

SEQ ID NO: 558 - DNA, 21 bp, Glycines max
gaagctgtttcatggggaaag

SEQ ID NO: 559 - DNA, 21 bp, Glycines max
gaagctgtttcatggggaaag

SEQ ID NO: 560 - DNA, 21 bp, Homo sapiens
gaggctgtctcctggggcaag

SEQ ID NO: 561 - DNA, 21 bp, Lactuca sativa
gaagctgtctcctgggggaaa

SEQ ID NO: 562 - DNA, 21 bp, Musa acuminate
gaggcgatttcatggggaaag

SEQ ID NO: 563 - DNA, 21 bp, Manihot esculenta
gaggctgtatcatggggaaaa

SEQ ID NO: 564 - DNA, 21 bp, Medicago sativa
gaggctgtttcatgggggaaa

SEQ ID NO: 565 - DNA, 21 bp, Oryza sativa Japonica
gaagcagtttcatggggaaag

SEQ ID NO: 566 - DNA, 21 bp, Populus deltoides
gaggctgtatcgtgggggaaa

SEQ ID NO: 567 - DNA, 21 bp, Phalaenopsis equestris
gaggctgtttcatggggaaaa

SEQ ID NO: 568 - DNA, 21 bp, Phaseolus vulgaris
gaggctgtttcgtgggggaaa

SEQ ID NO: 569 - DNA, 21 bp, Rosa chinensis
gaggctgtctcctgggggaaa

SEQ ID NO: 570 - DNA, 21 bp, Rosa chinensis
gaggctgtctcctgggggaaa

SEQ ID NO: 571 - DNA, 21 bp, Sorghum bicolor
gaagcagtctcatggggcaag

SEQ ID NO: 572 - DNA, 21 bp, Solanum lycopersicum
gaagctgtatcatggggaaag

SEQ ID NO: 573 - DNA, 21 bp, Solanum tuberosum
gaagctgtatcatggggaaag

SEQ ID NO: 574 - DNA, 21 bp, Triticum aestivum
gaagcagtttcatggggaaag

SEQ ID NO: 575 - DNA, 21 bp, Theobroma cacao
gaggctatttcatgggggaaa

SEQ ID NO: 576 - DNA, 21 bp, Vitis vinifera
gaggctgtgtcatgggggaaa

SEQ ID NO: 577 - DNA, 21 bp, Zea mays
gaagcagtctcatggggcaag

SEQ ID NO: 578 - DNA, 21 bp, Zea mays
gaagcggtttcatggggaaag

SEQ ID NO: 579 - DNA, 47 bp, Artificial Sequence
  Synthetic (OsDHS1 active site truncation; plant #2)
caacctgatgaagcagtttgattaaaggttcagccaaacccgtcaag

SEQ ID NO: 580 - DNA, 57 bp, Artificial Sequence
  Synthetic (OSAT WT)
caacctgatgaagcagtttcatggggaaagattaaaggttcagccaaacccgtcaag

SEQ ID NO: 581 - DNA, 27 bp, Artificial Sequence
  Synthetic
acccctttctaatttccaagtcggttt

SEQ ID NO: 582 - RNA, 44 nt, Artificial Sequence
  Synthetic
accccuuucuaauuuccaagucguagaugugaaucaucuuuaau

The invention claimed is:

1. A method of producing a plant with delayed senescence relative to a wild-type control plant, the method comprising inducing at least one nucleotide substitution into at least one copy of a gene encoding deoxyhypusine synthase (DHS) in the plant in a codon for at least one amino acid selected from the group consisting of K144, K292, D318, E328, A329, V330, S331, W332, K334, K343 of SEQ ID NO: 2, or a corresponding amino acid in another plant species, wherein the nucleotide substitution decreases the activity of DHS encoded by the gene in the plant relative to the activity of DHS in the wild-type control plant so as to delay senescence.

2. The method of claim 1, wherein the delayed senescence
a) increases seed yield in the plant relative to a wild-type control plant,
b) increases leaf and root biomass relative to a wild-type control plant,
c) enhances plant survival during drought or nutrient stress relative to a wild-type control plant,
d) increases disease resistance of the plant relative to a wild-type control plant, and/or
e) increases the period of time during which leaves, stems, seeds and fruit of the plant may be stored and remain suitable for use relative to a wild-type control plant.

3. The method of claim 1, wherein the plant is haploid, diploid, tetraploid, or polyploid.

4. The method of claim 1 comprising inducing at least one nucleotide substitution into at least two copies of a gene encoding DHS in the plant.

5. The method of claim 1, wherein the senescence is age-related senescence.

6. The method of claim 1, wherein the senescence is environmental stress-induced senescence.

7. A plant produced by the method of claim 1.

8. Progeny of the plant according to claim 7, wherein the progeny comprises the nucleotide substitution.

9. The method of claim 1, wherein the senescence is plant pathogen-induced senescence.

10. The method of claim 1, wherein the plant is selected from the group consisting of Triticum aestivum, Brassica

*napus, Gossypium hirsutum, Cicer arietinum, Glycine max, Phaseolus vulgar, Populus deltoides, Beta vulgaris, Oryza sativa, Sorghum bicolor, Zea mays, Brassica rapa, Arachis hypogaea, Vitis vinifera, Vitis labrusca, Theobroma cacao, Camellia sinensis, Lactuca sativa, Manihot esculenta, Phalaenopsis equestris, Coffea canephora, Camelina sativa, Musa acuminate, Medicago sativa, Rosa chinensis, Solanum lycopersicum*, and *Solanum tuberosum*.

11. A method of producing a plant with delayed senescence relative to a wild-type control plant, the method comprising inducing at least one nucleotide deletion or insertion into at least one copy of a gene encoding deoxyhypusine synthase (DHS) in the plant in a codon for at least one amino acid selected from the group consisting of K144, K292, D318, E328, A329, V330, S331, W332, K334, K343 of SEQ ID NO: 2, or a corresponding amino acid in another plant species, wherein the nucleotide deletion or insertion decreases the activity of DHS encoded by the gene in the plant relative to the activity of DHS in the wild-type control plant so as to delay senescence, and the plant contains at least one copy of the gene encoding DHS without the deletion or insertion.

12. The method of claim 11, wherein the delayed senescence
   a) increases seed yield in the plant relative to a wild-type control plant,
   b) increases leaf and root biomass relative to a wild-type control plant,
   c) enhances plant survival during drought or nutrient stress relative to a wild-type control plant,
   d) increases disease resistance of the plant relative to a wild-type control plant, and/or
   e) increases the period of time during which leaves, stems, seeds and fruit of the plant may be stored and remain suitable for use relative to a wild-type control plant.

13. The method of claim 11, wherein the plant is haploid, diploid, tetraploid, or polyploid.

14. The method of claim 11, wherein the senescence is age-related senescence.

15. The method of claim 11, wherein the senescence is environmental stress-induced senescence.

16. The method of claim 11, wherein the senescence is plant pathogen-induced senescence.

17. A plant produced by the method of claim 11.

18. Progeny of the plant according to claim 17, wherein the progeny comprises the nucleotide deletion or insertion.

19. The method of claim 11, wherein the plant is selected from the group consisting of *Triticum aestivum, Brassica napus, Gossypium hirsutum, Cicer arietinum, Glycine max, Phaseolus vulgar, Populus deltoides, Beta vulgaris, Oryza sativa, Sorghum bicolor, Zea mays, Brassica rapa, Arachis hypogaea, Vitis vinifera, Vitis labrusca, Theobroma cacao, Camellia sinensis, Lactuca sativa, Manihot esculenta, Phalaenopsis equestris, Coffea canephora, Camelina sativa, Musa acuminate, Medicago sativa, Rosa chinensis, Solanum lycopersicum*, and *Solanum tuberosum*.

* * * * *